United States Patent
Vroom et al.

(10) Patent No.: US 12,344,865 B2
(45) Date of Patent: Jul. 1, 2025

(54) BIOCATALYSTS AND METHODS FOR HYDROXYLATION OF CHEMICAL COMPOUNDS

(71) Applicant: Codexis, Inc., Redwood City, CA (US)

(72) Inventors: Jonathan Vroom, South San Francisco, CA (US); Alberto Ortega Guerra, Menlo Park, CA (US); Jack Liang, South San Francisco, CA (US); Gregory A. Cope, Menlo Park, CA (US); Nikki Dellas, San Carlos, CA (US); Christopher Keltie Prier, Rahway, NJ (US)

(73) Assignee: Codexis, Inc., Redwood City, CA (US)

( * ) Notice: Subject to any disclaimer, the term of this patent is extended or adjusted under 35 U.S.C. 154(b) by 342 days.

(21) Appl. No.: 17/776,900

(22) PCT Filed: Nov. 19, 2020

(86) PCT No.: PCT/US2020/061237
§ 371 (c)(1),
(2) Date: May 13, 2022

(87) PCT Pub. No.: WO2021/108209
PCT Pub. Date: Jun. 3, 2021

(65) Prior Publication Data
US 2023/0002744 A1    Jan. 5, 2023

Related U.S. Application Data

(60) Provisional application No. 62/940,647, filed on Nov. 26, 2019.

(51) Int. Cl.
*C12N 9/02* (2006.01)
*C12N 1/20* (2006.01)
*C12N 15/70* (2006.01)
*C12P 13/24* (2006.01)

(52) U.S. Cl.
CPC ............ *C12N 9/0071* (2013.01); *C12N 1/20* (2013.01); *C12N 15/70* (2013.01); *C12P 13/24* (2013.01); *C12Y 114/11002* (2013.01); *C12N 2800/101* (2013.01)

(58) Field of Classification Search
CPC ........ C12N 9/0071; C12N 1/20; C12N 15/70; C12N 2800/101; C12P 13/24; C12Y 114/11002
See application file for complete search history.

(56) References Cited

U.S. PATENT DOCUMENTS

| | | |
|---|---|---|
| 5,364,775 A | 11/1994 | Katsumata et al. |
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,854,040 A | 12/1998 | Ozaki et al. |
| 5,928,905 A | 7/1999 | Stemmer et al. |
| 5,962,292 A | 10/1999 | Ozaki et al. |
| 5,963,254 A | 10/1999 | Kim et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |

(Continued)

FOREIGN PATENT DOCUMENTS

| | | |
|---|---|---|
| EP | 0641862 B1 | 12/2001 |
| EP | 2290065 B1 | 8/2014 |

(Continued)

OTHER PUBLICATIONS

Kaelin et al. (Annu Rev Biochem, 2005, 74:115) (Year: 2005).*
Matsui, M., et al., "Genome Sequence of Fungal Species No. 11243, Which Produces the Antifungal Antibiotic FR901469," Genome Announcements, 3(2):1-2 [2015].
WO2021108209; Written Opinion of International Searching Authority; Apr. 7, 2021.
Ramaswarmy, S.G., et al., "One-vessel synthesis of 4-hydroxyproline from glyoxal and oxaloacetic acid," J. Org. Chem., 42(21):3440-3443 [1977].
Remuzon, P., "Trans-4-hydroxy-L-proline, a useful and versatile chiral starting block," Tetrahedron, 52 (44):13803-13835 [1996].
Romanos, M.A., et al., "Foreign gene expression in yeast: a review," Yeast 8:423-488 [1992].

(Continued)

*Primary Examiner* — David Steadman
*Assistant Examiner* — Joseph R Spangler
(74) *Attorney, Agent, or Firm* — FisherBroyles, LLP; Adam K. Whiting; Adelaide K. Leitzel

(57) ABSTRACT

The present invention provides engineered proline hydroxylase polypeptides for the production of hydroxylated compounds, polynucleotides encoding the engineered proline hydroxylases, host cells capable of expressing the engineered proline hydroxylases, and methods of using the engineered proline hydroxylases to prepare compounds useful in the production of active pharmaceutical agents.

7 Claims, No Drawings
Specification includes a Sequence Listing.

(56) References Cited

U.S. PATENT DOCUMENTS

| | | |
|---|---|---|
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,462,469 B2 | 6/2008 | Raillard et al. |
| 7,421,347 B2 | 9/2008 | Selifonov et al. |
| 7,430,477 B2 | 9/2008 | Selifonov et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Minshull et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 8,849,575 B2 | 9/2014 | Gustafsson et al. |
| 9,593,326 B2 | 3/2017 | Clark et al. |
| 2006/0195947 A1 | 8/2006 | Davis et al. |
| 2008/0220990 A1 | 9/2008 | Fox |
| 2009/0312196 A1 | 12/2009 | Colbeck et al. |
| 2011/0091942 A1 | 4/2011 | Kino et al. |
| 2013/0302859 A1 | 11/2013 | Haiblin et al. |
| 2015/0118719 A1 | 4/2015 | Chen et al. |
| 2023/0272354 A1 | 8/2023 | Nazor et al. |

FOREIGN PATENT DOCUMENTS

| | | |
|---|---|---|
| WO | 95/22625 A1 | 8/1995 |
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/008908 A2 | 1/2009 |
| WO | 2009/139365 A1 | 11/2009 |
| WO | 2009/152336 A1 | 12/2009 |
| WO | 2010/144103 A1 | 12/2010 |

OTHER PUBLICATIONS

Rychlik, W., et al., "Optimization of the annealing temperature for DNA amplification in vitro," Nucleic Acids Res, 18 (21):6409-6412 (1990).

Shibasaki, T., et al., "Microbial Proline 4-Hydroxylase Screening and Gene Cloning," Appl. Environ. Microbiol, 65 (9):4028-31 [1999].

Simonen, M., et al., "Protein Secretion in *Bacillus* Species," Microbiological Reviews, 57:109-137 (1993).

Smith, M., "In vitro mutagenesis," Ann. Rev. Genet., 19:423-462 (1985).

Smith, T., et al., "Comparison of Biosequences," Adv. Appl. Math, 2:482-489 (1981).

Stellwagen, E., "Dye Affinity Chromatography," Current Protocols in Protein Science, Chapter 9, Unit 9.2-9.2.16 [2001].

Stemmer, W., "DNA Shuffling by Random Fragmentation and Reassembly: In vitro Recombination for Molecular Evolution," Proc. Natl. Acad. Sci. USA, 91:10747-10751 (1994).

Stemmer, W.P.C., "Rapid evolution of a protein in vitro by DNA shuffling", Nature, 370:389-391 (1994).

Stenico, M., et al., "Codon usage in Caenorhabditis elegans: delineation of translational selection and mutational biases," Nucl. Acids Res. 22(13):2437-46 [1994].

Suggs, S.V., et al., "Use of synthetic oligodeoxyribonucleotides for the isolation of specific cloned DNA sequenes," In Developmental Biology Using Purified Genes (Brown et al., eds.), pp. 683-693, Academic Press (1981).

(56) References Cited

OTHER PUBLICATIONS

Tiwari, S., et al., "Prediction of probable genes by Fourier analysis of genomic sequences," Comput. Appl. Biosci. 13 (3):263-270 [1997].
Truppo, M.D., et al., "Development of an Improved Immobilized CAL-B for the Enzymatic Resolution of a Key Intermediate to Odanacatib," Organic Process Research & Development, 15:1033-1035 (2011).
Uberbacher, E.C., et al., "Discovering and Understanding Genes in Human DNA Sequence Using GRAIL," Methods Enzymol., 266:259-281 [1996].
Vergnon, A.L., et al., "Solid-phase synthesis of a library of hydroxyproline derivatives," J Comb Chem., 6(1):91-8 [2004].
Villa-Komaroff, L., et al., "A bacterial clone synthesizing proinsulin," Proc. Natl Acad. Sci. USA, 75:3727-3731 (1978).
Wada, K., et al., "Codon usage tabulated from the GenBank genetic sequence data," Nucl. Acids Res., 20:2111-2118 [1992].
Wells, J.A., et al., "Cassette mutagenesis: an efficient method for generation of multiple mutations at defined sites," Gene, 34:315-323 (1985).
Wetmur, J. G., "DNA Probes: Applications of the Principles of Nucleic Acid Hybridization," Crit Rev Biochem Mol Biol, 26(3/4):227-259 (1991).
Wright, F., "The 'effective number of codons' used in a gene," Gene 87:23-29 [1990].
Yaegaki, K.,et al., "Improved high-performance liquid chromatography method for quantitation of proline and hydroxyproline in biological materials," J Chromatogr., 356(1):163-70 [1986].
Yi, S., et al., "Covalent immobilization of omega-transaminase from Vibrio fluvialis JS17 on chitosan beads," Process Biochemistry 42(5): 895-898 (2007).
Zhang, J-H., et al., "Directed evolution of a fucosidase from a galactosidase by DNA shuffling and screening," Proc. Nat. Acad. Sci., U.S.A., 94:4504-4509 (1997).
Zhao, H., et al., "Molecular evolution by staggered extension process (StEP) in vitro recombination," Nat. Biotechnol., 16:258-261 (1998).
UniProtKB Accession No. A0AOS6XAW4 dated Feb. 17, 2016.
Altamura, M., et al., "2-Substituted penems with amino acid-related side chains: synthesis and antibacterial activity of a new series of beta-lactam antibiotics," J Med Chem., 38(21):4244-56 [1995].
Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Baldino, Jr., F., et al., "High-Resolution in Situ Hybridization Histochemistry," Methods Enzymology, 168:761-777 (1989).
Batzer, M.A., "Erratum: Structure and variability of recently inserted Alu family members", Nucleic Acids Res 19:698-699 [1991].
Beaucage, S.L., et al., "Deoxynucleoside phosphoamidites—A new class of key intermediates for deoxypolynucleotide synthesis," Tetrahedron Letters, 22(20):1859-62 (1981).
Black, M.E., et al., "Creation of drug-specific herpes simplex virus type 1 thymidine kinase mutants for gene therapy," Proc Natl Acad Sci USA, 93:3525-3529 (1996).
Bolton, E.T., et al., "A General Method for the Iisolation of RNA Complementary to DNA," Proc. Natl. Acad. Sci. USA 48:1390 (1962).
Botstein, D., et al., "Strategies and applications of in vitro mutagenesis," Science, 229(4719):1193-1201, 1985.
Breslauer, K.J., et al., "Predicting DNA duplex stability from the base sequence," Proc. Natl. Acad. Sci. USA, 83:3746-3750 (1986).
Cacho, R.A., et al., "Identification and Characterization of the Echinocandin B Biosynthetic Gene Cluster from Emericella rugulosa NRRL 11440," J. Am. Chem. Soc., 134:16781-16790 [2012].
Caldwell, R.C., et al., "Mutagenic PCR," PCR Methods Appl., 3:S136-S140 (1994).
Carter, P., "Site-directed mutagenesis," Biochem. J., 237:1-7 (1986).

Chen, K.X., et al., "Novel potent hepatitis C virus NS3 serine protease inhibitors derived from proline-based macrocycles," J Med Chem., 49(3):995-1005 [2006].
Chen, K.X., et al., "Syntheses of novel 4-tert-alkyl ether proline-based 16- and 17-membered macrocyclic compounds," J Org Chem., 67(8):2730-3 [2002].
Christians, F.C., et al., "Directed evolution of thymidine kinase for AZT phosphorylation using DNA family shuffling," Nat. Biotechnol., 17:259-264 (1999).
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling,"Nat. Biotechnol., 14(3):315-319 (1996).
Crameri, A., et al., "Molecular evolution of an arsenate detoxification pathway by DNA shuffling," Nat. Biotechnol., 15 (5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Efimov, V.A., et al., "Hydroxyproline-based DNA mimics provide an efficient gene silencing in vitro and in vivo," Nucleic Acids Res., 34(8):2247-2257 [2006].
Eguchi, C., et al., "The novel synthesis of L-Hydroxyproline from D-Glutamic Acid," Bull. Chem. Soc. Japan, 47 (7):1704-08 [1974].
Fasman, G.D.,CRC Practical Handbook of Biochemistry and Molecular Biology, CRC Press, Boca Raton, FL, pp. 3-70 [1989].
Freier, S.M., et al., "Improved free-energy parameters for predictions of RNA duplex stability," Proc. Natl. Acad. Sci USA, 83:9373-9377 (1986).
Guo, Z., et al., "3'-End-Forming Signals of Yeast mRNA," Mol. Cell. Biol., 15(11):5983-5990 [1995].
Hara, R., "Characterization of novel 2-oxoglutarate dependent dioxygenases converting L-proline to cis-4-hydroxy-I-proline," Biochem Biophys Res Commun., 379(4):882-6 [2009].
Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S., et al., "Amino acid substitution matrices from protein blocks," Proc. Natl. Acad. Sci., 89:10915-10919 (1992).
Houwaart, S., et al., "Pneumocandin Biosynthesis: Involvement of a trans-Selective Proline Hydroxylase," ChemBioChem, 15:2365-2369 [2014].
Kierzek, R., et al., "Polymer-Supported RNA Synthesis and Its Application To Test the Nearest-Neighbor Model for Duplex Stability," Biochemistry, 25:7840-7846 (1986).
Klein, C., et al., "A Simple Procedure for Selective Hydroxylation of l-Proline and l-Pipecolic Acid with Recombinantly Expressed ProlineHydroxylases," Adv Synth. Catal., 353:1375-1383 [2011].
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of E. coli," Cell, 38(3):879-887 [1984].
Lawrence, C.C., et al., "Purification and initial characterization of proline 4-hydroxylase from Streptomyces griseoviridus P8648: a 2-oxoacid, ferrous-dependent dioxygenase involved in etamycin biosynthesis," Biochem. J., 313:185-191 [1996].
Lee, Y.K., et al., "The novel synthesis of two diastereomers of gamma-hydroxyproline," Bull. Chem. Soc. Japan, 46:2924-26 [1973].
Ling, M., et al., "Approaches to DNA Mutagenesis:An Overview," Anal. Biochem., 254:157-78 (1997).
Majamaa, K., et al., "Differences between collagen hydroxylases and 2-oxoglutarate dehydrogenase in their inhibition by structural analogues of 2-oxoglutarate," Biochem. J., 229:127-133 [1985].
Martin, A.R., et al., "Characterization of free and immobilized (S)-aminotransferase for acetophenone production," Applied Microbiology and Biotechnology, 76(4): 843-851 (2007).

(56) References Cited

OTHER PUBLICATIONS

Mateo, C., et al., "Epoxy sepabeads: a novel epoxy support for stabilization of industrial enzymes via very intense multipoint covalent attachment," Biotechnology Progress 18(3):629-34 (2002).

Matsui, M., et al., "Identification of a putative FR901469 biosynthesis gene cluster in fungal sp. No. 11243 and enhancement of the productivity by overexpressing the transcriptionfactor gene frbF," J. Biosci. Bioeng., 123(2): 147-153 [2017].

Matthes, H.W.D., et al., "Simultaneous rapid chemical synthesis of over one hundred oligonucleotides on a microscale," EMBO J., 3(4):801-05 (1984).

McInerney, J.O., "GCUA: general codon usage analysis," Bioinformatics, 14(4):372-73, 1998.

Minshull, J., et al., "Protein evolution by molecular breeding," Curr. Op. Chem. Biol., 3(3):284-290 (1999).

Mori, H., et al., "Detection of Novel Proline 3-Hydroxylase Activities in Streptomyces and Bacillus spp. by Regio- and Stereospecific Hydroxylation of I-Proline," Appl. Environ. Microbiol., 62:1903-1907 [1996].

Nakamura, Y., et al., "Codon usage tabulated from international DNA sequence databases: status for the year 2000," Nucl. Acids Res., 28:292 [2000].

Needleman, S., et al., "A general method applicable to the search for similarities in the amino acid sequence of two proteins," J. Mol. Biol. 48:443-453 (1970).

O'Connell, C.E., et al., "Synthesis and evaluation of some hydroxyproline-derived peptidomimetics as isoprenyltransferase inhibitors" Chem Pharm Bull., 48(5):740-742 [2000].

Pearson, W.R., "Improved tools for biological sequence comparison," Proc. Nat'l. Acad. Sci. USA, 85:2444-2448 (1988).

Petersen, L. et al., "Novel proline hydroxylase activities in the pneumocandin-producing fungus Glarea lozoyensis responsible for the formation of trans 3- and trans 4-hydroxyproline," Appl Microbiol Biotechnol., 62(2-3):263-7 [2003].

\* cited by examiner

BIOCATALYSTS AND METHODS FOR HYDROXYLATION OF CHEMICAL COMPOUNDS

The present application is a national stage application filed under 35 USC § 371 and claims priority to PCT International Application No. PCT/US2020/061237, filed Nov. 19, 2020, which claims priority to U.S. Prov. Pat. Appln. Ser. No. 62/940,647, filed Nov. 26, 2019, both of which are is incorporated by reference in their entireties for all purposes.

TECHNICAL FIELD

The invention relates to biocatalysts for the hydroxylation of chemical compounds.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-193WO1_ST25.txt", a creation date of Nov. 17, 2020, and a size of 1,456,832 bytes. The Sequence Listing filed via EFS-Web is part of the specification and is incorporated in its entirety by reference herein.

BACKGROUND

Proline derivatives with functional groups on the ring carbons are useful building blocks for synthesis of pharmaceutical compounds because of the constrained conformation of proline. One such derivative, hydroxylated proline, is a starting material for the synthesis of various therapeutic compounds, including carbapenem antibiotics (See e.g., Altamura et al., J. Med., Chem. 38(21):4244-56 [1995]), angiotensin-converting enzyme inhibitors, protease inhibitors (See e.g., Chen et al., J. Org. Chem., 67(8):2730-3 [2002]; Chen et al., 2006, J Med Chem. 49(3):995-1005), nucleic acid analogs (See e.g., Efimov et al., Nucleic Acids Res., 34(8):2247-2257 [2006]), isoprenyltransferase inhibitors (O'Connell et al., Chem. Pharm. Bull., 48(5):740-742 [2000]), and drug library construction (Vergnon et al., J. Comb. Chem., 6(1):91-8 [2004]; and Remuzon, Tetrahedron 52:13803-13835 [1996]).

Hydroxyproline can be obtained from natural sources, such as plant materials and hydrolyzates of collagen. Hydroxyproline can also be chemically synthesized, such as from starting materials allyl bromide and diethylacetamidomalonic acid (Kyun Lee et al., Bull. Chem. Soc. Japan, 46:2924 [1973]), D-glutamic acid (Eguchi et al., Bull. Chem. Soc. Japan, 47:1704-08 [1974]), glyoxal and oxaloacetic acid (Ramaswamy et al., J. Org. Chem., 42(21):3440-3443 [1977]), and α-alanine (Sinha et al., Proc. ECSOC-4, The Fourth International Electronic Conference on Synthetic Organic Chemistry, ISBN 3-906980-05-7 [2000]).

Isolation from natural sources is limited by the availability of raw materials, requires purification from a significant amount of background contaminants, and lacks certain desired diastereomers. Chemical synthetic methods can require complex steps, be difficult to scale up to industrial scale levels, and require additional purification steps due to formation of multiple hydroxylated products.

Another approach for preparing hydroxylated proline uses proline hydroxylases, which are 2-oxoglutarate-dependent dioxygenases, utilizing 2-oxoglutarate (α-ketoglutarate) and $O_2$ as co-substrates and ferrous ion as a cofactor (See e.g., Klein et al., Adv. Synth. Catal., 353:1375-1383 [2011]; U.S. Pat. No. 5,364,775; and Shibasaki et al., Appl. Environ. Microbiol., 65(9):4028-4031 [1999]). Unlike prolyl hydroxylases that specifically recognize peptidyl proline in procollagen and related peptides, proline hydroxylases are capable of converting free proline to hydroxyproline. Several microbial enzymes that produce cis-3-, cis-4- or trans-4-hydroxyproline are known in the art (See e.g., U.S. Pat. Nos. 5,962,292, 5,963,254, and 5,854,040; WO2009139365; and EP2290065), and an enzyme that produces trans-3-hydroxyproline has been identified in extracts of the fungus. Many of the proline hydroxylases are found in bacteria and fungi, where they are associated with the biosynthesis of peptide antibiotics.

A natural proline hydroxylase that is selective for trans-3-hydroxyproline is not known in the art. The fungal proline hydroxylase from *Glarea lozoyensis*, GloF, produces trans-3-hydroxyproline as the minor isomer together with the major isomer trans-4-hydroxyproline (Petersen et al., Appl. Microbiol. Biotechnol. 2003, 62, 263; Houwaart et al., ChemBioChem 2014, 15, 2365). Another fungal proline hydroxylase from *Emericella rugulosa* NRRL 11440, HtyE, sharing approximately 64% sequence of identity with GloF, was reported as part of an echinocandin B biosynthetic gene cluster (Cacho et al., J. Am. Chem. Soc. 2012, 134, 16781). HtyE was also found to produce trans-3-hydroxyproline as the minor isomer together with the major isomer trans-4-hydroxyproline. Recently, a gene cluster that includes three hydroxylase genes was identified in fungal sp.11243 (Matsui et al., J. Biosci. Bioeng. 2017, February; 123(2): 147-153), and one gene was subsequently identified as having homology to HtyE.

While recombinant whole cells expressing cloned proline hydroxylases are better suited for large scale industrial processes, the use of whole cells limits variations in reaction conditions, such as high substrate concentrations; restricts the types of substrates that can be used to those that are permeable to the cells; and results in undesirable by-products that must be separated from the final product. In addition, in vivo systems may require defined growth media that are not optimal or cost effective because the use of rich growth media prepared from protein hydrolyzates contain free proline, which can be a competitive inhibitor when substrates other than proline are being targeted. Alternative methods for synthesizing hydroxylated forms of proline and proline analogs, as well as other chemical compounds, that can be readily scaled up and result in substantially pure isomeric product are necessary.

SUMMARY OF THE INVENTION

The present invention provides engineered proline hydroxylase biocatalysts, polynucleotides encoding the biocatalysts, methods of their preparation, and processes for preparing hydroxylated compounds using these engineered biocatalysts. The proline hydroxylases of the present invention have been engineered to have one or more improved properties relative to the naturally occurring proline hydroxylase (SEQ ID NO: 2 to which an N-terminal his-tag has been added) of ANO11243 from fungal sp. No. 11243. The improved biocatalyst properties of the engineered proline hydroxylases include, among others, activity, substrate tolerance, stereoselectivity, regioselectivity, and thermostability. The engineered proline hydroxylases have also been found to hydroxylate a variety of substrate compounds, including the hydroxylation of L-proline into trans-3-hydroxyproline using alpha-ketoglutarate as a co-substrate. In some embodiments, the process is conducted in the presence of oxygen (i.e., air) and iron (i.e., Fe(II)).

The engineered enzymes with one or more improved properties have one or more residue differences as compared to the naturally occurring proline hydroxylase, where the residue differences occur at residue positions affecting one or more of the foregoing enzyme properties.

Accordingly, in one aspect, the present invention provides engineered polypeptides having proline hydroxylase activity, where the polypeptides comprise an amino acid sequence having at least about 80% identity to SEQ ID NO: 4, 116, 162, 322, 412, 492, 562, 598, and/or 630. In some embodiments, the present invention provides engineered polypeptides having proline hydroxylase activity, wherein the polypeptides comprise an amino acid sequence set forth in the even-numbered sequences in the range of SEQ ID NO: 6-658. The following detailed description provides guidance on the choices of the residue differences that can be used to prepare engineered proline hydroxylases with the desired improved biocatalytic properties.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 4. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 4, and one or more residue differences as compared to SEQ ID NO: 4 at residue positions selected from: 21, 28, 58/247, 65, 80, 85, 95, 98, 117, 120, 159, 185, 194, 199, 200, 233, 237, 243, 250, 268, 281, 282, 287, 289, 307, 324, 326, 327, 330, 338, 343, 346, and 348. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 4, and one or more residue differences as compared to SEQ ID NO: 4 at residue positions selected from: 21, 28, 45, 65, 95, 112, 117, 139, 177, 185, 199, 233, 243, 250, 281, 282, 287, 289, 307, 324, 326, 327, 335, 338, 343, and 346. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 4, and one or more residue differences as compared to SEQ ID NO: 4 at residue positions selected from 48/66/189/194, 48/66/194, and 66/82/85/135/189/194/267. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 4, and one or more residue differences as compared to SEQ ID NO: 4 at residue positions selected from 20/56/76/168/169/296, 20/56/232/294, 20/119/294/296, 56/76/119/124/147/232, 56/76/294, 76/168/232/294, 76/294/296, 76/296, 147, and 232. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 4-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 116. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 116, and one or more residue differences as compared to SEQ ID NO: 116 at residue positions selected from: 123, 189, 195, 233, and 296. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 116, and one or more residue differences as compared to SEQ ID NO: 116 at residue positions selected from 20/21/56, 20/21/56/76/95/232/294/307/335, 20/21/56/76/147/225/232/233/281/294/296/307/335, 20/21/56/95/147/281/294/307, 20/21/56/281/307, 20/21/76/232/243, 20/21/95/232/307, 20/21/95/281/294/296, 20/21/147/189/233/243/281/307, 20/56, 20/56/76/95/281/307, 20/56/76/147/294/296/307, 20/56/95/147/294, 20/56/281, 20/76, 20/76/95/281/294/296, 20/76/95/281/296/307, 20/76/233/294/307, 20/76/243/281/294, 21/76/147/233/294/307, 21/76/147/243/296/307/335, 21/95/185/189/232/281/296, 21/95/233/243/281/296, 21/95/294/296/307/335, 21/95/307, 21/281/307, 29/76/281, 56/76/95/232/243/281, 56/76/147/281/307, 56/76/243/294, 56/76/281/294, 56/76/296, 56/76/307, 56/95/147/307/335/348, 56/95/232/233/281/294/307, 56/95/243/281, 56/147/281, 56/232/243/281, 56/232/281, 56/232/281/294/296, 56/233/281/294/296, 56/281/307, 76/95/232/243/281/307, 76/95/243/281/307/335, 76/95/294/307, 76/147, 76/147/233/243/294, 76/147/233/281/294/307, 76/147/243/294/296/307/335, 76/147/281/307, 76/189/296, 76/232/233/243/294/296/307, 76/281, 76/281/294, 76/294/296, 95/120, 95/147/335, 95/232/243/281/294/307, 95/232/281/294/296, 95/281/294/296, 95/335, 147, 147/225/232/243/281/296/307/335, 147/233/243/281/307, 147/233/281/307/335, 147/243/281, 147/307, 232/233/281/294/296/307, 232/281, 232/284/307, 233/243/281/296/307/335, 233/281/296/307, 243/281/294/296, 281, 281/294, 281/307, 307, and 335. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 116, and one or more residue differences as compared to SEQ ID NO: 116 at residue positions selected from: 21/76/147/243/296/307/335, 56/76/147/281/307, and 95/147/335. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 4-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 162. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO:

162, and one or more residue differences as compared to SEQ ID NO: 162 at residue positions selected from 2/85/123/237, 28/115/117/120/123/268/270/343/346/348, 45/123/326, 65/117/120/123/343/346, 85/123/281/282, 114/115/117/120/123/268/271/313/326/343/346, 123/139/233/237/281/282/289/324/326, and 123/199/200/247/250/338. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 6-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 322. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 322, and one or more residue differences as compared to SEQ ID NO: 322 at residue positions selected from 26, 54, 61, 129, 132, 149, 156, 175, 189, 201, 209, 228, 236, 248, 262, 272, 277, 291, and 345. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 322, and one or more residue differences as compared to SEQ ID NO: 322 at residue positions selected from 25, 43, 54, 58, 61, 79, 129, 132, 143, 156, 163, 175, 179, 201, 209, 236, 248, 278, 291, 345, and 347. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 322, and one or more residue differences as compared to SEQ ID NO: 322 at residue positions selected from 85/117/120/135/208/270/324/343/346, 85/117/120/135/208/281/282/289, 85/117/120/270/281/289, 85/117/135/139/208, and 117/120/208/270/324/343/346. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 6-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 412. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 412, and one or more residue differences as compared to SEQ ID NO: 412 at residue positions selected from 47, 48, 56/118, 85, 95, 95/289, 113, 118, 118/247, 154, 162, 162/204, 164, 164/198/271, 168, 169, 187, 195, 243, 271, 275, 281, 314, 330, and 342. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 412, and one or more residue differences as compared to SEQ ID NO: 412 at residue positions selected from 25/129/163/236/262/345/347, 120/156/175/179/201, 129/189/236/262/277/278, 129/236/262, 156/175/179/228, and 162. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 6-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 492. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 492, and one or more residue differences as compared to SEQ ID NO: 492 at residue positions selected from 15, 17, 28, 29, 65, 135, 167, 177, 199, 208, 228, 235, 287, 294, 307, and 343. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 492, and one or more residue differences as compared to SEQ ID NO: 492 at residue positions selected from 85/187/281/347, 85/187/347, 118/120/162/175/179/330, 118/120/162/175/330, 162/175/179/330, 175/228/330, 195/347, and 278/314/347. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 6-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 562. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 562, and one or more residue differences as compared to SEQ ID NO: 562 at residue positions selected from 15, 40, 43, 44, 59, 79, 82, 149, 164, 179, 345, and 347. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 562, and one or more residue differences as compared to SEQ ID NO: 562 at residue positions selected from 29/85/177/208/228/347, 29/85/208/228/343/347, 29/177/195/228/343, 29/208/228/278/294/347, 56/195/278, 85/187/205/208/278, 113/177/187/195/208/278/294/343/347, and 177/205/208/228. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 6-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 598. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 598, and one or more residue differences as compared to SEQ ID NO: 598 at residue positions selected from 47, 162, 209, 219, 227, and 342. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 598, and one or more residue differences as compared to SEQ ID NO: 598 at residue positions selected from 17/44/179/195/250/313/345, 17/44/199/313, 43/44/195/199, 44/149/164/171/187, 44/179/195/199, 44/179/195/199/345, 79/163/164/171/187/201/286/288, 82/163/164, 82/163/164/171/187/201/203/208/286/288/320, 149/164/171/288, and 187/286. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 6-658.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 630. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO: 630, and one or more residue differences as compared to SEQ ID NO: 630 at residue positions selected from 82/164/171/203/208, 135/163/164/201/203/208, 162, 162/219/236, 162/219/313/338, 162/236/342, 162/313/342, and 164/171/201/203/282. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOs: 6-658.

The present invention also provides engineered polypeptides having proline hydroxylase activity capable of converting L-proline into trans-3-hydroxyproline. In some embodiments, the engineered polypeptide is capable of converting L-proline into trans-3-hydroxyproline with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold or more the activity of the naturally occurring enzyme. In some further embodiments, the engineered polypeptide is capable of converting L-proline into trans-3-hydroxyproline with greater than 90%, 91%, 92%, 93%, 94%, 95%, 96%, 97%, 98%, 99% or more isomeric excess of trans-3-hydroxyproline.

The present invention also provides polynucleotides encoding the engineered polypeptide having proline hydroxylase activity. In some embodiments, the polynucleotide comprises a nucleic acid sequence optimized for expression in *E. coli*.

The present invention further provides expression vectors comprising the polynucleotides encoding the engineered polypeptide having proline hydroxylase activity. In some embodiments, the expression vectors comprise at least one control sequence.

The present invention also provides host cells comprising the polynucleotide encoding engineered polypeptides having proline hydroxylase activity. In some embodiments, the host cell is *E. coli*.

The present invention further provides methods of preparing engineered polypeptides having proline hydroxylase activity, comprising culturing the host cell comprising an expression vector comprising at least one polynucleotide encoding an engineered polypeptide having proline hydroxylase activity under conditions suitable for expression of the polypeptide(s). In some embodiments, the methods further comprise the step of isolating the engineered polypeptide(s).

DESCRIPTION OF THE INVENTION

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention.

The section headings used herein are for organizational purposes only and not to be construed as limiting the subject matter described.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

Abbreviations

The abbreviations used for the genetically encoded amino acids are conventional and are as follows:

| Amino Acid | Three-Letter Abbreviation | One-Letter Abbreviation |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "polynucleotide" and "nucleic acid" refer to two or more nucleosides that are covalently linked together. The polynucleotide may be wholly comprised of ribonucleotides (i.e., RNA), wholly comprised of 2' deoxyribonucleotides (i.e., DNA) or mixtures comprised of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

"Coding sequence" refers to that portion of a nucleic acid (e.g., a gene) that encodes an amino acid sequence of a protein.

"Proline hydroxylase" refers to a polypeptide having an enzymatic capability of converting free proline to hydroxyproline in presence of co-substrate α-ketoglutarate and dioxygen, as illustrated below:

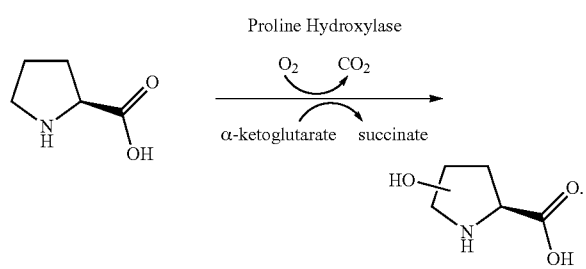

It is to be understood that proline hydroxylases are not limited to the foregoing reaction with proline, but may hydroxylate other substrates or produce various isomers of hydroxyproline, for example trans-3-hydroxyproline. Proline hydroxylases as used herein include naturally occurring (wild-type) proline hydroxylases as well as non-naturally occurring engineered polypeptides generated by human manipulation. In some embodiments, the proline hydroxylase variants of the present invention are capable of converting L-proline to trans-3-hydroxyproline, as shown in Scheme 1, below:

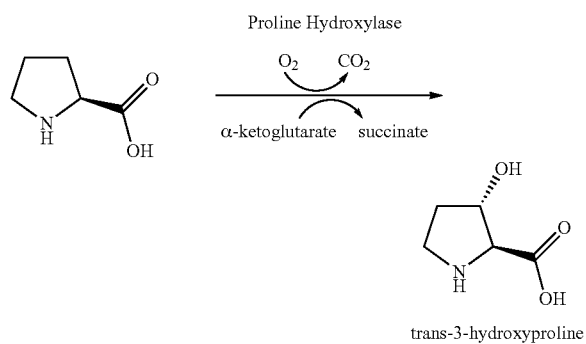

"Co-substrate" of a proline hydroxylase refers to α-ketoglutarate and co-substrate analogs that can replace α-ketoglutarate in hydroxylation of proline and proline substrate analogs. Co-substrate analogs include, by way of example and not limitation, 2-oxoadipate (See e.g., Majamaa et al., Biochem. J., 229:127-133 [1985]).

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occuring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E)

of 10, M=5, N=-4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

"Reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered proline hydroxylase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, or at least 95 percent sequence identity or more (e.g., 99 percent sequence identity). In some embodiments, residue positions that are not identical in sequences being compared differ by conservative amino acid substitutions.

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X93 as compared to SEQ ID NO:4" refers to a difference in the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" refers to an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than that in the reference polypeptide). In some instances (e.g., in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention comprises one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered proline hydroxylase enzyme. Deletions can be directed to the internal portions and/or terminal portions of the polypeptide. In various embodiments, the deletion can comprise a continuous segment or can be discontinuous.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" or a "biologically active fragment" used interchangeably herein refers to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered proline hydroxylase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., within a host cell or via in vitro synthesis). The recombinant proline hydroxylase polypeptides may be present within a cell, present in the cellular medium, or prepared in various forms, such as lysates or isolated preparations. As such, in some embodiments, the recombinant proline hydroxylase polypeptides can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising proline hydroxylase comprises proline hydroxylase that is less than 50% pure (e.g., about 10%, about 20%, about 30%, about 40%, or about 50%) Generally, a substantially pure proline hydroxylase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant proline hydroxylase polypeptides are substantially pure polypeptide compositions.

As used herein, "improved enzyme property" refers to at least one improved property of an enzyme. In some embodiments, the present invention provides engineered proline hydroxylase polypeptides that exhibit an improvement in any enzyme property as compared to a reference proline hydroxylase polypeptide, and/or a wild-type proline hydroxylase polypeptide and/or another engineered proline hydroxylase polypeptide. Thus, the level of "improvement" can be determined and compared between various proline hydroxylase enzymes, including wild-type, as well as engineered proline hydroxylases. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to basic pH, increased tolerance to proteolytic activity (i.e., reduced sensitivity to proteolysis), reduced aggregation, increased solubility, and altered temperature profile.

As used herein, "increased enzymatic activity" and "enhanced catalytic activity" refer to an improved property of the engineered proline hydroxylase polypeptides, which can be represented by an increase in specific activity (e.g., product produced/time/weight protein) or an increase in percent conversion of the substrate to the product (e.g., percent conversion of starting amount of substrate to product in a specified time period using a specified amount of proline hydroxylase) as compared to the reference proline hydroxylase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring proline hydroxylase or another engineered proline hydroxylase from which the proline hydroxylase polypeptide was derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a proline hydroxylase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides proline hydroxylase variants with generalist properties, in that they demonstrate similar or improved activity relative to the parental gene for a wide range of sterically and electronically diverse substrates. In addition, the generalist enzymes provided herein were engineered to be improved across a wide range of diverse API-like molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, MA [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered proline hydroxylase enzyme of the present invention.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the proline hydroxylase enzymes may be codon optimized for optimal production in the host organism selected for expression.

"Preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli* and *Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

"Control sequence" refers herein to include all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refers to those conditions in the enzymatic conversion reaction solution (e.g., ranges of enzyme loading, substrate loading, temperature, pH, buffers, co-solvents, etc.) under which a proline hydroxylase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the proline hydroxylase polypeptide.

As used herein, "product" in the context of an enzymatic conversion process refers to the compound or molecule resulting from the action of the proline hydroxylase polypeptide on a substrate.

As used herein the term "culturing" refers to the growing of a population of microbial cells under any suitable conditions (e.g., using a liquid, gel or solid medium).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant proline hydroxylase polypeptides" (also referred to herein as "engineered proline hydroxylase polypeptides," "variant proline hydroxylase enzymes," and "proline hydroxylase variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example, a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the proline hydroxylase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess.

"Highly stereoselective" refers to a chemical or enzymatic reaction that is capable of converting a substrate (e.g., L-proline), to its corresponding hydroxylated product (e.g., trans-3-hydroxyproline), with at least about 85% stereomeric excess.

"Regioselectivity" or "regioselective reaction" refers to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites, for example, preferential formation of the product compound (i.e., trans-3-hydroxyproline over the undesired product trans-4-hydroxyproline).

"Selective" or "selectivity" may refer to either stereoselective or regioselective, as defined above, or may refer to both stereoselective and regioselective.

"Isomeric excess" refers to a percentage calculated according to the formula [major isomer−minor isomer]/[major isomer+minor isomer]. This percentage represents the preferential formation of one isomer over the other in a chemical or enzymatic reaction. Enantiomeric excess is a form of isomeric excess.

As used herein, "thermostable" refers to a proline hydroxylase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to a proline hydroxylase polypeptide that maintains similar activity (more than e.g., 60% to 80%) after exposure to varying concentrations (e.g., 5-99%) of solvent (e.g., ethanol, isopropyl alcohol, dimethylsulfoxide [DMSO], tetrahydrofuran, 2-methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to a proline hydroxylase polypeptide that is both thermostable and solvent stable.

As used herein, "reductant" refers to a compound or agent capable of converting $Fe^{+3}$ to $Fe^{+2}$. An exemplary reductant is ascorbic acid, which is generally in the form of L-ascorbic acid.

"Alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., $(C_1-C_6)$alkyl refers to an alkyl of 1 to 6 carbon atoms).

"Alkenyl" refers to hydrocarbon groups of from 2 to 12 carbon atoms inclusively, either straight or branched containing at least one double bond but optionally containing more than one double bond.

"Alkynyl" refers to hydrocarbon groups of from 2 to 12 carbon atoms inclusively, either straight or branched containing at least one triple bond but optionally containing more than one triple bond, and additionally optionally containing one or more double bonded moieties.

"Alkylene" refers to a straight or branched chain divalent hydrocarbon radical having from 1 to 18 carbon atoms inclusively, more preferably from 1 to 8 carbon atoms inclusively, and most preferably 1 to 6 carbon atoms inclusively, optionally substituted with one or more suitable substituents. Exemplary "alkylenes" include, but are not limited to, methylene, ethylene, propylene, butylene, and the like.

"Alkenylene" refers to a straight or branched chain divalent hydrocarbon radical having 2 to 12 carbon atoms inclusively and one or more carbon-carbon double bonds, more preferably from 2 to 8 carbon atoms inclusively, and most preferably 2 to 6 carbon atoms inclusively, optionally substituted with one or more suitable substituents.

"Heteroalkyl, "heteroalkenyl," and heteroalkynyl," refer respectively, to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —$NR^y$—, —PH—, —S(O)—, —$S(O)_2$—, —$S(O)NR^y$—, —$S(O)_2NR^y$—, and the like, including combinations thereof, where each $R^y$ is independently selected from hydrogen, alkyl, cycloalkyl, heterocycloalkyl, aryl, and heteroaryl.

"Aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

"Arylalkyl" refers to an alkyl substituted with an aryl (i.e., aryl-alkyl- groups), preferably having from 1 to 6 carbon atoms inclusively in the alkyl moiety and from 6 to 12 carbon atoms inclusively in the aryl moiety. Such arylalkyl groups are exemplified by benzyl, phenethyl and the like.

"Aryloxy" refers to —OR$^\lambda$ groups, where R$^\lambda$ is an aryl group, which can be optionally substituted.

"Cycloalkyl" refers to cyclic alkyl groups of from 3 to 12 carbon atoms inclusively having a single cyclic ring or multiple condensed rings which can be optionally substituted with from 1 to 3 alkyl groups. Exemplary cycloalkyl groups include, but are not limited to, single ring structures such as cyclopropyl, cyclobutyl, cyclopentyl, cyclooctyl, 1-methylcyclopropyl, 2-methylcyclopentyl, 2-methylcyclooctyl, and the like, or multiple ring structures, including bridged ring systems, such as adamantyl, and the like.

"Cycloalkylalkyl" refers to an alkyl substituted with a cycloalkyl (i.e., cycloalkyl-alkyl- groups), preferably having from 1 to 6 carbon atoms inclusively in the alkyl moiety and from 3 to 12 carbon atoms inclusively in the cycloalkyl moiety. Such cycloalkylalkyl groups are exemplified by cyclopropylmethyl, cyclohexylethyl and the like.

"Amino" refers to the group —NH$_2$. Substituted amino refers to the group —NHR$^\eta$, NR$^\eta$R$^\eta$, and NR$^\eta$R$^\eta$R$^\eta$, where each R$^\eta$ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylsulfonylamino, furanyl-oxy-sulfamino, and the like.

"Aminoalkyl" refers to an alkyl group in which one or more of the hydrogen atoms are replaced with one or more amino groups, including substituted amino groups.

"Aminocarbonyl" refers to —C(O)NH$_2$. Substituted aminocarbonyl refers to —C(O)NR$^\eta$R$^\eta$, where the amino group NR$^\eta$R$^\eta$ is as defined herein.

"Oxy" refers to a divalent group —O—, which may have various substituents to form different oxy groups, including ethers and esters.

"Alkoxy" or "alkyloxy" are used interchangeably herein to refer to the group —OR$^\xi$, wherein R$^\xi$ is an alkyl group, including optionally substituted alkyl groups.

"Carboxy" refers to —COOH.

"Carbonyl" refers to —C(O)—, which may have a variety of substituents to form different carbonyl groups including acids, acid halides, aldehydes, amides, esters, and ketones.

"Carboxyalkyl" refers to an alkyl in which one or more of the hydrogen atoms are replaced with one or more carboxy groups.

"Aminocarbonylalkyl" refers to an alkyl substituted with an aminocarbonyl group, as defined herein.

"Halogen" or "halo" refers to fluoro, chloro, bromo and iodo.

"Haloalkyl" refers to an alkyl group in which one or more of the hydrogen atoms are replaced with a halogen. Thus, the term "haloalkyl" is meant to include monohaloalkyls, dihaloalkyls, trihaloalkyls, etc. up to perhaloalkyls. For example, the expression "(C$_1$-C$_2$) haloalkyl" includes 1-fluoromethyl, difluoromethyl, trifluoromethyl, 1-fluoroethyl, 1,1-difluoroethyl, 1,2-difluoroethyl, 1,1,1 trifluoroethyl, perfluoroethyl, etc.

"Hydroxy" refers to —OH.

"Hydroxyalkyl" refers to an alkyl group in which in which one or more of the hydrogen atoms are replaced with one or more hydroxy groups.

"Thiol" or "sulfanyl" refers to —SH. Substituted thiol or sulfanyl refers to —S—R$^\eta$, where R$^\eta$ is an alkyl, aryl or other suitable substituent.

"Alkylthio" refers to —SR$^\xi$, where R$^\xi$ is an alkyl, which can be optionally substituted. Typical alkylthio group include, but are not limited to, methylthio, ethylthio, n-propylthio, and the like.

"Alkylthioalkyl" refers to an alkyl substituted with an alkylthio group, —SR$^\xi$, where R$^\xi$ is an alkyl, which can be optionally substituted.

"Sulfonyl" refers to —SO$_2$—. Substituted sulfonyl refers to —SO$_2$—R$^\eta$, where R$^\eta$ is an alkyl, aryl or other suitable substituent.

"Alkylsulfonyl" refers to —SO$_2$—R$^\xi$, where R$^\xi$ is an alkyl, which can be optionally substituted. Typical alkylsulfonyl groups include, but are not limited to, methylsulfonyl, ethylsulfonyl, n-propylsulfonyl, and the like.

"Alkylsulfonylalkyl" refers to an alkyl substituted with an alkylsulfonyl group, —SO$_2$—R$^\xi$, where R$^\xi$ is an alkyl, which can be optionally substituted.

"Heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

"Heteroarylalkyl" refers to an alkyl substituted with a heteroaryl (i.e., heteroaryl-alkyl- groups), preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

"Heterocycle", "heterocyclic" and interchangeably "heterocycloalkyl" refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

"Heterocycloalkylalkyl" refers to an alkyl substituted with a heterocycloalkyl (i.e., heterocycloalkyl-alkyl- groups), preferably having from 1 to 6 carbon atoms inclusively in the alkyl moiety and from 3 to 12 ring atoms inclusively in the heterocycloalkyl moiety.

"Membered ring" is meant to embrace any cyclic structure. The number preceding the term "membered" denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

"Fused bicyclic ring" as used herein refers to both unsubstituted and substituted carbocyclic and/or heterocyclic ring moieties having 5 to 8 atoms in each ring, the rings having 2 common atoms.

Unless otherwise specified, positions occupied by hydrogen in the foregoing groups can be further substituted with substituents exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

"Optional" or "optionally" means that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

Engineered Proline Hydroxylase Polypeptides

The present invention provides polypeptides having proline hydroxylase activity, polynucleotides encoding the polypeptides, methods of preparing the polypeptides, and methods for using the polypeptides. Where the description relates to polypeptides, it is to be understood that it can describe the polynucleotides encoding the polypeptides.

Proline hydroxylases belong to a class of dioxygenase enzymes that catalyze hydroxylation of proline in the presence of alpha-ketoglutarate and oxygen ($O_2$). The alpha-ketoglutarate is stoichiometrically decarboxylated during hydroxylation, with one atom of the $O_2$ molecule being incorporated into the succinate and the other into the hydroxyl group formed on the proline residue. As noted above, proline hydroxylases are distinguished from prolyl hydroxylases by their ability to hydroxylate free proline.

Several types of proline hydroxylases have been identified based on the major diastereomeric products formed in the enzymatic reaction: cis-3-proline hydroxylase (cis-P3H), cis-4-proline hydroxylase (cis-P4H), trans-3-proline hydroxylase (trans-P3H), and trans-4-proline hydroxylase (trans-P4H). Cis-P3H enzymes have been identified in *Streptomyces* sp. TH1, *Streptomyces canus* and *Bacillus* sp. TH2 and TH3 (Mon et al., Appl. Environ. Microbiol., 62 (6):1903-1907 [1996]). Cis-P4H enzymes have been identified in *Lotus corniculatus rhizobia, Mesorhibozium loti, Sinorhizobium meliloti*, and *Medicago sativa rhizobia*, (Hara and Kino, Biochem. Biophys. Res. Commun., 379(4):882-6 [2009]; US Pat. Appln. Publ. No. 2011/0091942). Trans-P4H have been identified in *Dactylosporangium* sp., *Amycolatopsis* sp., *Streptomyces griseoviridus, Streptomyces* sp., *Glarea lozoyensis*, and *Emericella rugulosa* NRRL 11440 (Shibasaki et al., Appl. Environ. Microbiol., 65(9):4028-31 [1999]; Petersen et al., Appl. Microbiol. Biotechnol., 62(2-3):263-7 [2003]; Mori et al., Appl. Environ. Microbiol., 62:1903-1907 [1996]; Lawrence et al., Biochem. J., 313: 185-191 [1996]; and EP 0641862; Cacho et al., J. Am. Chem. Soc. 2012, 134, 16781).

Recently, a gene cluster that includes three hydroxylase genes was identified in fungal sp.11243 (Matsui et al., J. Biosci. Bioeng. 2017, February; 123(2): 147-153). Subsequently, one of these genes was identified as a proline hydroxylase and characterized as a trans-selective proline hydroxylase. The proline hydroxylase from fungal sp. No. 11243 (referred to as ANO11243 or ANO) converts free proline to both trans-4-hydroxyproline and trans-3-hydroxyproline, with a slight enrichment for the trans-3-hydroxyproline isomer. However, the naturally occurring ANO11243 proline hydroxylase lacks properties that would make it useful in large-scale industrial processes, including low specific activity, low thermostability, and low selectivity for the desired trans-3-hydroxyproline isomer.

Engineered proline hydroxylases that overcome the deficiencies of the wild-type proline hydroxylase from fungal sp. No. 11243 are described herein. The engineered proline hydroxylase polypeptides derived from the wild-type enzyme ANO from fungal sp. No. 11243 are capable of efficiently converting L-proline to trans-3-hydroxyproline. The present invention identifies amino acid residue positions and corresponding mutations in the proline hydroxylase polypeptide sequence that improve enzyme properties as compared to the naturally occurring enzyme, including among others, activity, stability, expression, regioselectivity, and stereoselectivity. In particular, the present invention provides engineered polypeptides capable of efficiently converting L-proline to trans-3-hydroxyproline (as illustrated in Scheme 1, above) in presence of a co-substrate (e.g., alpha-ketoglutarate) under suitable reaction conditions (e.g, in the presence of oxygen and Fe(II)).

In some embodiments, the engineered proline hydroxylase polypeptides show increased activity in the hydroxylation L-proline to trans-3-hydroxyproline, in a defined time with the same amount of enzyme as compared to the polypeptide of SEQ ID NO: 4. In some embodiments, the engineered proline hydroxylase polypeptide has at least about 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity under suitable reaction conditions as compared to the polypeptide represented by SEQ ID NOs: 4, 116, 162, 322, 412, 492, 562, 598, and/or 630.

In some embodiments, the engineered proline hydroxylase polypeptides have increased regioselectivity as compared to the wild-type proline hydroxylase. Specifically, the naturally occurring enzyme converts proline to, primarily if not exclusively, trans-3-hydroxyproline. In some embodiments, the engineered proline hydroxylase polypeptides herein are capable of selectively forming trans-3-hydroxyproline in excess of trans-4-hydroxyproline. In some embodiments, the engineered polypeptides are capable of selectively forming trans-3-hydroxyproline in excess of trans-4-hydroxyproline, where the ratio of trans-3-hydroxyproline formed over compound trans-4-hydroxyproline under suitable reaction conditions is at least 1.5, 2, 3, 4, 5, 10, 15, 20, 25, 30 or more.

In some embodiments, the engineered proline hydroxylase polypeptides are capable of converting L-proline to trans-3-hydroxyproline at a substrate loading concentration of at least about 10 g/L, about 20 g/L, about 30 g/L, about 40 g/L, about 50 g/L, about 70 g/L, about 100 g/L, about 125 g/L, about 150 g/L. about 175 g/L or about 200 g/L or more with a percent conversion of at least about 40%, at least about 50%, at least about 60%, at least about 70%, at least about 80%, at least about 90%, at least about 95%, at least about 98%, or at least about 99%, in a reaction time of about 120 h or less, 72 h or less, about 48 h or less, about 36 h or less, or about 24 h less, under suitable reaction conditions.

The suitable reaction conditions under which the above-described improved properties of the engineered polypeptides carry out the hydroxylation reaction can be determined with respect to concentrations or amounts of polypeptide, substrate, co-substrate, transition metal cofactor, reductant, buffer, co-solvent, pH, conditions including temperature and reaction time, and/or conditions with the polypeptide immobilized on a solid support, as further described below and in the Examples.

In some embodiments, exemplary engineered polypeptides having proline hydroxylase activity with improved properties, particularly in the conversion of L-proline to trans-3-hydroxyproline, comprises an amino acid sequence that has one or more residue differences as compared to by SEQ ID NOs: 4, 116, 162, 322, 412, 492, 562, 598, and/or 630 at the residue positions indicated in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1.

The structure and function information for exemplary non-naturally occurring (or engineered) proline hydroxylase polypeptides of the present invention are based on the conversion of L-proline to trans-3-hydroxyproline, the results of which are shown below in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1. The odd numbered sequence identifiers (i.e., SEQ ID NOs) refer to the nucleotide sequence encoding the amino acid sequence provided by the even numbered SEQ ID NOs. The exemplary sequences are provided in the electronic sequence listing file accompanying this invention, which is hereby incorporated by reference herein. The amino acid residue differences are based on comparison to the reference sequence of SEQ ID NOs: 4, 116, 162, 322, 412, 492, 562, 598, and/or 630. The naturally occurring amino acid sequence of the proline hydroxylase ANO from fungal sp. No. 11243 is provided as SEQ ID NO: 2 herein (the corresponding polynucleotide sequence is SEQ ID NO: 1, as provided herein). The activity of each engineered polypeptide relative to the reference polypeptide of SEQ ID NO: 4, 116, 162, 322, 412, 492, 562, 598, and/or 630 was determined as conversion of the substrates described in the Examples herein. In some embodiments, a shake flask powder (SFP) or downstream processed (DSP) powder assay is used as a secondary screen to assess the properties of the engineered proline hydroxylases, the results of which are provided in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1. The SFP forms provide a more purified powder preparation of the engineered polypeptides and can contain the engineered polypeptides that are up to about 30% of total protein. The DSP preparations can provide an even further purified form of the engineered polypeptide since the preparations can contain the engineered proline hydroxylases that are up to about 80% of total protein.

In some embodiments, the specific enzyme properties associated with the residues differences as compared to SEQ ID NO: 4, 116, 162, 322, 412, 492, 562, 598, and/or 630 at the residue positions indicated herein include, among others, enzyme activity, substrate tolerance, thermostability, regioselectivity, and stereoselectivity. Improvements in enzyme activity are associated with residue differences at residue positions indicated in the Examples herein. Improvements in selectivity are associated with residue differences at residue positions indicated in the Examples herein. Improvements in thermostability are associated with residue differences at residue positions indicated in the Examples herein. Accordingly, the residue differences at these residue positions can be used individually or in various combinations to produce engineered proline hydroxylase polypeptides having the desired improved properties, including, among others, enzyme activity, substrate tolerance, regioselectivity, stereoselectivity, and thermostability. Other residue differences affecting polypeptide expression can be used to increase expression of the engineered proline hydroxylase.

In light of the guidance provided herein, it is further contemplated that any of the exemplary engineered polypeptides comprising the even-numbered sequences of SEQ ID NOs: 4-658 find use as the starting amino acid sequence for synthesizing other engineered proline hydroxylase polypeptides, for example by subsequent rounds of evolution that incorporate new combinations of various amino acid differences from other polypeptides in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1, and other residue positions described herein. Further improvements may be generated by including amino acid differences at residue positions that had been maintained as unchanged throughout earlier rounds of evolution.

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4, and one or more residue differences as compared to SEQ ID NO: 4 at residue positions selected from 21, 28, 58/247, 65, 80, 85, 95, 98, 117, 120, 159, 185, 194, 199, 200, 233, 237, 243, 250, 268, 281, 282, 287, 289, 307, 324, 326, 327, 330, 338, 343, 346, and 348. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from 21Q, 28A, 58V/247V, 65A, 80H, 85L, 95P, 95R, 98L, 117E, 117L, 117R, 117S, 117T, 120F, 159G, 185D, 194L, 194T, 199A, 200V, 233A, 233R, 237E, 243A, 243V, 250Q, 268H, 281S, 282E, 282S, 287E, 289D, 307I, 324D, 326G, 326H, 326K, 327Q, 330G, 338I, 343N, 343P, 346S, and 348S (relative to SEQ ID NO: 4). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from R21Q, P28A, E58V/P247V, S65A, K80H, E85L, G95P, G95R, Q98L, A117E, A117L, A117R, A117S, A117T, L120F, Q159G, A185D, N194L, N194T, T199A, P200V, V233A, V233R, Q237E, L243A, L243V, V250Q, R268H, R281S, L282E, L282S, D287E, M289D, V307I, A324D, R326G, R326H, R326K, W327Q, L330G, M338I, V343N, V343P, A346S, and Q348S (relative to SEQ ID NO: 4).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences at residue positions selected from: 21, 28, 45, 65, 95, 112, 117, 139, 177, 185, 199, 233, 243, 250, 281, 282, 287, 289, 307, 324, 326, 327, 335, 338, 343, and 346. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from: 21Q, 28A, 45S, 65A, 95R, 112L, 117S, 139F, 177P, 185D, 199A, 233A, 243V, 250Q, 250T, 281S, 281T, 282E, 282S, 287E, 289D, 307I, 324D, 326G, 326H, 326K, 327Q, 335A, 335M, 338I, 343N, 343P, and 346S (relative to SEQ ID NO: 4). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from R21Q, P28A, Y45S, S65A, G95R, RI 12L, A117S, M139F, S177P, A185D, T199A, V233A, L243V, V250Q, V250T, R281S, R281T, L282E, L282S, D287E, M289D, V307I, A324D, R326G, R326H, R326K, W327Q, S335A, S335M, M338I, V343N, V343P, and A346S (relative to SEQ ID NO: 4).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences at residue positions selected from: 48/66/189/194, 48/66/194, and 66/82/85/135/189/194/267. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from: 48V/66W/189N/194L, 48V/66W/194L, and 66W/82P/85P/135P/189N/194L/267D (relative to SEQ ID NO: 4). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from A48V/Y66W/A189N/N194L, A48V/Y66W/N194L, and Y66W/K82P/E85P/A135P/A189N/N194L/G267D (relative to SEQ ID NO: 4).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences at residue positions selected from: 20/56/76/168/169/296, 20/56/232/294, 20/119/294/296, 56/76/119/124/147/232, 56/76/294, 76/168/232/294, 76/294/296, 76/296, 147, and 232. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from: 20F/56P/76E/168A/169L/296I, 20F/56P/232E/294Y, 20F/119D/294Y/296I, 56P/76E/119D/124F/147F/232E, 56P/76E/294Y, 76E/168A/232E/294Y, 76E/294Y/296I, 76E/296I, 147F, and 232E (relative to SEQ ID NO: 4). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4 and one or more residue differences selected from Y20F/S56P/H76E/C168A/I169L/L296I, Y20F/S56P/Q232E/H294Y, Y20F/E119D/H294Y/L296I, S56P/H76E/E119D/W124F/Y147F/Q232E, S56P/H76E/H294Y, H76E/C168A/Q232E/H294Y, H76E/H294Y/L296I, H76E/L296I, Y147F, and Q232E (relative to SEQ ID NO: 4).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116, and one or more residue differences as compared to SEQ ID NO: 116 at residue positions selected from 123, 189, 195, 233, and 296. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences selected from 123T, 189A, 189S, 195Y, 233A, 233M, and 296V (relative to SEQ ID NO: 116). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences selected from S123T, N189A, N189S, H195Y, V233A, V233M, and L296V (relative to SEQ ID NO: 116).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences at residue positions selected from: 20/21/56, 20/21/56/76/95/232/294/307/335, 20/21/56/76/147/225/232/233/281/294/296/307/335, 20/21/56/95/147/281/294/307, 20/21/56/281/307, 20/21/76/232/243, 20/21/95/232/307, 20/21/95/281/294/296, 20/21/147/189/233/243/281/307, 20/56, 20/56/76/95/281/307, 20/56/76/147/294/296/307, 20/56/95/147/294, 20/56/281, 20/76, 20/76/95/281/294/296, 20/76/95/281/296/307, 20/76/233/294/307, 20/76/243/281/294, 21/76/147/233/294/307, 21/76/147/243/296/307/335, 21/95/185/189/232/281/296, 21/95/233/243/281/296, 21/95/294/296/307/335, 21/95/307, 21/281/307, 29/76/281, 56/76/95/232/243/281, 56/76/147/281/307, 56/76/243/294, 56/76/281/294, 56/76/296, 56/76/307, 56/95/147/307/335/348, 56/95/232/233/281/294/307, 56/95/243/281, 56/147/281, 56/232/243/281, 56/232/281, 56/232/281/294/296, 56/233/281/294/296, 56/281/307, 76/95/232/243/281/307, 76/95/243/281/307/335, 76/95/294/307, 76/147, 76/147/233/243/294, 76/147/233/281/294/307, 76/147/243/294/296/307/335, 76/147/281/307, 76/189/296, 76/232/233/243/294/296/307, 76/281, 76/281/294, 76/294/296, 95/120, 95/147/335, 95/232/243/281/294/307, 95/232/281/294/296, 95/281/294/296, 95/335, 147, 147/225/232/243/281/296/307/335, 147/233/243/281/307, 147/233/281/307/335, 147/243/281, 147/307, 232/233/281/294/296/307, 232/281, 232/284/307, 233/243/281/296/307/335, 233/281/296/307, 243/281/294/296, 281, 281/294, 281/307, 307, and 335, 117, 139, 177, 185, 199, 233, 243, 250, 281, 282, 287, 289, 307, 324, 326, 327, 335, 338, 343, and 346. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences selected from: 20F/21Q/56P, 20F/21Q/56P/76E/95R/232E/294Y/307I/335M, 20F/21Q/56P/76E/147F/225R/232E/233A/281S/294Y/296I/307L/335M, 20F/21Q/56P/95R/147F/281T/294Y/307I, 20F/21Q/56P/281T/307L, 20F/21Q/76E/232E/243V, 20F/21Q/95R/232E/307I, 20F/21Q/95R/281T/294Y/296I, 20F/21Q/147F/189A/233R/243V/281T/307I, 20F/56P, 20F/56P/76E/95R/281S/307I, 20F/56P/76E/147F/294Y/296I/307L, 20F/56P/95P/147F/294Y, 20F/56P/281S, 20F/76E, 20F/76E/95R/281S/294Y/296I, 20F/76E/95R/281T/296I/307I, 20F/76E/233A/294Y/307I, 20F/76E/243V/281T/294Y, 21Q/76E/147F/233R/294Y/307I, 21Q/76E/147F/243V/296I/307I/335M, 21Q/95R/185L/189A/232E/281T/296I, 21Q/95R/233A/243V/281T/296I, 21Q/95R/294Y/296I/307I/335M, 21Q/95R/307I, 21Q/281T/307L, 29T/76E/281T, 56P/76E/95R/232E/243V/281T, 56P/76E/147F/281T/307I, 56P/76E/243V/294Y, 56P/76E/281T/294Y, 56P/76E/296I, 56P/76E/307I, 56P/95P/147F/307I/335M/348K, 56P/95R/232E/233R/281S/294Y/307L, 56P/95R/243V/281T, 56P/147F/281T, 56P/232E/243V/281S, 56P/232E/281S, 56P/232E/281S/294Y/296I, 56P/233R/281S/294Y/296I, 56P/281T/307I, 76E/95P/232E/243V/281S/307I, 76E/95R/243V/281S/307I/335M, 76E/95R/294Y/307L, 76E/147F, 76E/147F/233A/243V/294Y, 76E/147F/233R/281T/294Y/307L, 76E/147F/243V/294Y/296I/307L/335M, 76E/147F/281S/307L, 76E/189A/296I, 76E/232E/233R/243V/294Y/296I/307I, 76E/281S, 76E/281T/294Y, 76E/294Y/296I, 95P/232E/281T/294Y/296I, 95P/335M, 95R/120P, 95R/147F/335M, 95R/232E/243V/281T/294Y/307I, 95R/281T/294Y/296I, 95R/335M, 147F, 147F/225R/232E/243V/281S/296I/307L/335M, 147F/233A/243V/281S/307L, 147F/233R/281T/307L/335M, 147F/243V/281S, 147F/307I, 232E/233A/281T/294Y/296I/307I, 232E/281T, 232E/284R/307I, 233A/243V/281S/296I/307I/335M, 233A/281T/296I/307I, 243V/281S/294Y/296I, 281T, 281T/294Y, 281T/307I, 281T/307L, 307I, and 335M (relative to SEQ ID NO: 116). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences selected from Y20F/R21Q/S56P, Y20F/R21Q/S56P/H76E/G95R/Q232E/H294Y/V307I/S335M, Y20F/R21Q/S56P/H76E/Y147F/Q225R/Q232E/V233A/R281S/H294Y/L296I/V307L/S335M, Y20F/R21Q/S56P/G95R/Y147F/R281T/H294Y/V307I, Y20F/R21Q/S56P/R281T/V307L, Y20F/R21Q/H76E/Q232E/L243V, Y20F/R21Q/G95R/Q232E/V307I, Y20F/R21Q/G95R/R281T/H294Y/L296I, Y20F/R21Q/Y147F/N189A/V233R/L243V/R281T/V307I, Y20F/S56P, Y20F/S56P/H76E/G95R/R281S/V307I, Y20F/S56P/H76E/Y147F/H294Y/L296I/V307L, Y20F/S56P/G95P/Y147F/H294Y, Y20F/S56P/R281S, Y20F/H76E, Y20F/H76E/G95R/R281S/H294Y/L296I, Y20F/H76E/G95R/R281T/L296I/V307I, Y20F/H76E/V233A/H294Y/V307I, Y20F/H76E/L243V/R281T/H294Y, R21Q/H76E/Y147F/V233R/H294Y/V307I, R21Q/H76E/Y147F/L243V/L296I/V307I/S335M, R21Q/G95R/A185L/N189A/Q232E/R281T/L296I, R21Q/G95R/V233A/L243V/R281T/L296I, R21Q/G95R/H294Y/L296I/V307I/S335M, R21Q/G95R/V307I, R21Q/R281T/V307L, A29T/H76E/R281T, S56P/H76E/G95R/Q232E/L243V/R281T, S56P/H76E/Y147F/R281T/V307I, S56P/H76E/L243V/H294Y, S56P/H76E/R281T/H294Y, S56P/H76E/L296I, S56P/H76E/V307I, S56P/G95P/Y147F/V307I/S335M/Q348K, S56P/G95R/Q232E/V233R/R281S/H294Y/V307L, S56P/G95R/L243V/R281T, S56P/Y147F/R281T, S56P/Q232E/L243V/R281S, S56P/Q232E/R281S, S56P/Q232E/R281S/H294Y/L296I, S56P/V233R/R281S/H294Y/L296I, S56P/R281T/V307I, H76E/G95P/Q232E/L243V/R281S/V307L, H76E/G95R/L243V/R281S/V307I/S335M, H76E/G95R/H294Y/V307L, H76E/Y147F, H76E/Y147F/V233A/L243V/H294Y, H76E/Y147F/V233R/R281T/H294Y/V307L, H76E/Y147F/L243V/H294Y/L296I/V307L/S335M, H76E/Y147F/R281S/V307L, H76E/N189A/L296I, H76E/Q232E/V233R/L243V/H294Y/L296I/V307I, H76E/R281S, H76E/R281T/H294Y, H76E/H294Y/L296I, G95P/Q232E/R281T/H294Y/L296I, G95P/S335M, G95R/L120P, G95R/Y147F/S335M, G95R/Q232E/L243V/R281T/H294Y/V307I, G95R/R281T/H294Y/L296I, G95R/S335M, Y147F, Y147F/Q225R/Q232E/L243V/R281S/L296I/V307L/S335M, Y147F/V233A/L243V/R281S/V307L, Y147F/V233R/R281T/V307L/S335M, Y147F/L243V/R281S, Y147F/V307I, Q232E/V233A/R281T/H294Y/L296I/V307I, Q232E/R281T, Q232E/G284R/V307I, V233A/L243V/R281S/L296I/V307I/S335M, V233A/R281T/L296I/V307I, L243V/R281S/H294Y/L296I, R281T, R281T/H294Y, R281T/V307I, R281T/V307I, V307I, and S335M (relative to SEQ ID NO: 116).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences at residue positions selected from: 21/76/147/ 243/296/307/335, 56/76/147/281/307, and 95/147/335. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences selected from: 21Q/76E/147F/243V/296I/307I/ 335M, 56P/76E/147F/281T/307I, and 95R/147F/335M (relative to SEQ ID NO: 116). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116 and one or more residue differences selected from R21Q/H76E/Y147F/L243V/L296I/V307I/S335M, S56P/ H76E/Y147F/R281T/V307I, and G95R/Y147F/S335M (relative to SEQ ID NO: 116).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 162, and one or more residue differences as compared to SEQ ID NO: 162 at residue positions selected from 2/85/123/237, 28/115/117/120/123/ 268/270/343/346/348, 45/123/326, 65/117/120/123/343/ 346, 85/123/281/282, 114/115/117/120/123/268/271/313/ 326/343/346, 123/139/233/237/281/282/289/324/326, and 123/199/200/247/250/338. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 162 and one or more residue differences selected from 2L/85L/123T/237E, 28A/115T/117V/120I/123T/268T/ 270L/343N/346S/348S, 45S/123T/326G, 65R/117V/120I/ 123T/343N/346G, 85L/123T/281T/282S, 114G/115T/117T/ 120P/123T/268T/271A/313F/326G/343N/346S, 123T/ 139F/233A/237E/281M/282S/289D/324Q/326G, and 123T/ 199A/200V/247L/250Q/338I (relative to SEQ ID NO: 162). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 162 and one or more residue differences selected from G2L/E85L/S123T/Q237E, P28A/ V115T/A17V/L120I/S123T/R268T/R270L/V343N/A346S/ Q348S, Y45S/S123T/R326G, S65R/A117V/L120I/S123T/ V343N/A346G, E85L/S123T/R281T/L282S, E114G/ V115T/A117T/L120P/S123T/R268T/S271A/L313F/ R326G/V343N/A346S, S123T/M139F/V233A/Q237E/ R281M/L282S/M289D/A324Q/R326G, and S123T/T199A/ P200V/P247L/V250Q/M338I (relative to SEQ ID NO: 162).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322, and one or more residue differences as compared to SEQ ID NO: 322 at residue positions selected from 26, 54, 61, 129, 132, 149, 156, 175, 189, 201, 209, 228, 236, 248, 262, 272, 277, 291, and 345. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences selected from 26N, 54P, 61H, 129I, 132P, 149G, 156S, 175S, 175V, 189S, 201C, 201G, 201T, 209S, 228T, 236T, 248R, 262V, 272S, 277A, 291G, and 345R (relative to SEQ ID NO: 322). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences selected from G26N, G54P, D61H, A129I, E132P, S149G, V156S, L175S, L175V, N189S, A201C, A201G, A201T, C209S, V228T, Q236T, D248R, S262V, V272S, V277A, P291G, and T345R (relative to SEQ ID NO: 322).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences at residue positions selected from: 25, 43, 54, 58, 61, 79, 129, 132, 143, 156, 163, 175, 179, 201, 209, 236, 248, 278, 291, 345, and 347. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences selected from: 25K, 43T, 54P, 54S, 58T, 61H, 79T, 129I, 132N, 143L, 156D, 156S, 163L, 175V, 179L, 201C, 209S, 236T, 248R, 278N, 291G, 345R, and 347E (relative to SEQ ID NO: 322). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences selected from H25K, A43T, G54P, G54S, E58T, D61H, Q79T, A129I, E132N, D143L, V156D, V156S, Q163L, L175V, E179L, A201C, C209S, Q236T, D248R, S278N, P291G, T345R, and A347E (relative to SEQ ID NO: 322).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences at residue positions selected from: 85/117/120/135/208/270/324/343/346, 85/117/120/135/208/281/282/289, 85/117/120/270/281/289, 85/117/135/139/208, and 117/120/208/270/324/343/346. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences selected from: 85L/117T/120P/135S/208E/281R/282L/289M, 85L/117T/135S/139M/208E, 85L/117V/120I/135S/208E/270L/324A/343N/346G, 85L/117V/120P/270L/281R/289M, and 117T/120I/208E/270L/324A/343N/346G (relative to SEQ ID NO: 322). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322 and one or more residue differences selected from E85L/A117T/L120P/A135S/A208E/M281R/S282L/D289M, E85L/A117T/A135S/F139M/A208E, E85L/A117V/L120I/A135S/A208E/R270L/Q324A/V343N/A346G, E85L/A117V/L120P/R270L/M281R/D289M, and A117T/L120I/A208E/R270L/Q324A/V343N/A346G (relative to SEQ ID NO: 322).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 412 and one or more residue differences at residue positions selected from: 47, 48, 56/118, 85, 95, 95/289, 113, 118, 118/247, 154, 162, 162/204, 164, 164/198/271, 168, 169, 187, 195, 243, 271, 275, 281, 314, 330, and 342. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 412 and one or more residue differences selected from: 47M, 48G, 56P/118W, 85P, 95A/289V, 95W, 113H, 113N, 113P, 113R, 118D, 118P/247A, 118V, 118W, 154L, 162A, 162L, 162M, 162V, 162V/204S, 164D/198V/271V, 164T, 168V, 169C, 169T, 169V, 187P, 195Y, 243Y, 271V, 275K, 281L, 314A, 314S, 314T, 330G, 330H, and 342R (relative to SEQ ID NO: 412). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 412 and one or more residue differences selected from F47M, V48G, S56P/A118W, L85P, G95A/M289V, G95W, S113H, S113N, S113P, S113R, A118D, A118P/P247A, A118V, A118W, F154L, H162A, H162L, H162M, H162V, H162V/L204S, S164D/A198V/S271V, S164T, C168V, 1169C, 1169T, 1169V, C187P, H195Y, V243Y, S271V, R275K, R281L, F314A, F314S, F314T, L330G, L330H, and N342R (relative to SEQ ID NO: 412).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 412, and one or more residue differences as compared to SEQ ID NO: 412 at residue positions selected from 25/129/163/236/262/345/347, 120/156/175/179/201, 129/189/236/262/277/278, 129/236/262, 156/175/179/228, and 162. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 412 and one or more residue differences selected from 25K/129I/163L/236T/262V/345R/347E, 120V/156S/175V/179L/201G, 129I/189S/236T/262V/277A/278N, 129I/236T/262V, 156S/175V/179L/228A, 162L, and 162V (relative to SEQ ID NO: 412). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 412 and one or more residue differences selected from H25K/A129I/Q163L/Q236T/S262V/T345R/A347E, P120V/V156S/L175V/E179L/A201G, A129I/N189S/Q236T/S262V/V277A/S278N, A129I/Q236T/S262V, V156S/L175V/E179L/V228A, H162L, and H162V (relative to SEQ ID NO: 412).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 492 and one or more residue differences at residue positions selected from: 15, 17, 28, 29, 65, 135, 167, 177, 199, 208, 228, 235, 287, 294, 307, and 343. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 492 and one or more residue differences selected from: 15V, 17C, 281, 29S, 65V, 135G, 135N, 135T, 167G, 177A, 177L, 177P, 199C, 208L, 208M, 208S, 228T, 235E, 287E, 294T, 307L, 343S, and 343T (relative to SEQ ID NO: 492). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 492 and one or more residue differences selected from I15V, S17C, P28I, A29S, S65V, S135G, S135N, S135T, Q167G, S177A, S177L, S177P, T199C, E208L, E208M, E208S, V228T, D235E, D287E, H294T, I307L, V343S, and V343T (relative to SEQ ID NO: 492).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 492, and one or more residue differences as compared to SEQ ID NO: 492 at residue positions selected from 85/187/281/347, 85/187/347, 118/120/162/175/179/330, 118/120/162/175/330, 162/175/179/330, 175/228/330, 195/347, and 278/314/347. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 492 and one or more residue differences selected from 85P/187P/281L/347E, 85P/187P/347E, 118V/120V/162V/175V/179L/330H, 118V/120V/162V/175V/330H, 162V/175V/179L/330H, 175V/228A/330H, 195Y/347E, and 278S/314A/347E (relative to SEQ ID NO: 492). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 492 and one or more residue differences selected from L85P/C187P/R281L/A347E, L85P/C187P/A347E, A118V/P120V/H162V/L175V/E179L/L330H, A118V/P120V/H162V/L175V/L330H, H162V/L175V/E179L/L330H, L175V/V228A/L330H, H195Y/A347E, and N278S/F314A/A347E (relative to SEQ ID NO: 492).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 562 and one or more residue differences at residue positions selected from: 15, 40, 43, 44, 59, 79, 82, 149, 164, 179, 345, and 347. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 562 and one or more residue differences selected from: 15F, 40A, 43S, 44R, 44V, 59L, 79E, 82A, 149N, 164Q, 179T, 345D, and 347K (relative to SEQ ID NO: 562). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 562 and one or more residue differences selected from 115F, K40A, A43S, G44R, G44V, R59L, Q79E, K82A, S149N, S164Q, L179T, T345D, and A347K (relative to SEQ ID NO: 562).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 562, and one or more residue differences as compared to SEQ ID NO: 562 at residue positions selected from 29/85/177/208/228/347, 29/85/208/228/343/347, 29/177/195/228/343, 29/208/228/278/294/347, 56/195/278, 85/187/205/208/278, 113/177/187/195/208/278/294/343/347, and 177/205/208/228. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 562 and one or more residue differences selected from 29S/85P/177A/208S/228T/347E, 29S/85P/208L/228T/343T/347E, 29S/177P/195Y/228T/343T, 29S/208S/228T/278S/294T/347E, 56P/195Y/278S, 85P/187P/205S/208L/278S, 113N/177P/187P/195Y/208S/278S/294Y/343T/347E, and 177A/205S/208L/228T (relative to SEQ ID NO: 562). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 562 and one or more residue differences selected from A29S/L85P/S177A/E208S/V228T/A347E, A29S/L85P/E208L/V228T/V343T/A347E, A29S/S177P/H195Y/V228T/V343T, A29S/E208S/V228T/N278S/H294T/A347E, S56P/H195Y/N278S, L85P/C187P/A205S/E208L/N278S, S113N/S177P/C187P/H195Y/E208S/N278S/H294Y/V343T/A347E, and S177A/A205S/E208L/V228T (relative to SEQ ID NO: 562).

In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 598 and one or more residue differences at residue positions selected from: 47, 162, 209, 219, 227, and 342. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 598 and one or more residue differences selected from: 47Q, 162S, 209H, 219V, 227R, 342L, and 342M (relative to SEQ ID NO: 598). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 598 and one or more residue differences selected from F47Q, V162S, C209H, T219V, S227R, N342L, and N342M (relative to SEQ ID NO: 598).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 598, and one or more residue differences as compared to SEQ ID NO: 598 at residue positions selected from 17/44/179/195/250/313/345, 17/44/199/313, 43/44/195/199, 44/149/164/171/187, 44/179/195/199, 44/179/195/199/345, 79/163/164/171/187/201/286/288, 82/163/164, 82/163/164/171/187/201/203/208/286/288/320, 149/164/171/288, and 187/286. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 598 and one or more residue differences selected from 17V/44R/199C/313C, 17V/44V/179T/195Y/250P/313C/345D, 43S/44V/195Y/199C, 44R/179T/195Y/199C, 44R/179T/195Y/199C/345D, 44V/149N/164Q/171M/187P, 44V/179T/195Y/199C/345D, 79E/163D/164Q/171M/187N/201V/286P/288T, 82A/163D/164Q, 82A/163D/164Q/171M/187P/201V/203Q/208I/286P/288T/320V, 149N/164Q/171M/288T, and 187P/286P (relative to SEQ ID NO: 598). In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 598 and one or more residue differences selected from S17V/G44R/T199C/L313C, S17V/G44V/L179T/H195Y/V250P/L313C/T345D, A43S/G44V/H195Y/T199C, G44R/L179T/H195Y/T199C, G44R/L179T/H195Y/T199C/T345D, G44V/S149N/S164Q/T171M/C187P, G44V/L179T/H195Y/T199C/T345D, Q79E/Q163D/S164Q/T171M/C187N/A201V/A286P/V288T, K82A/Q163D/S164Q, K82A/Q163D/S164Q/T171M/C187P/A201V/S203Q/L208I/A286P/V288T/K320V, S149N/S164Q/T171M/V288T, and C187P/A286P (relative to SEQ ID NO: 598).

In some embodiments, the engineered polypeptide having proline hydroxylase activity with one or more improved properties as compared to SEQ ID NO: 4, 116, 162, 322, 412, 492, 562, 598, and/or 630 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 630, and one or more residue differences as compared to SEQ ID NO: 630 at residue positions selected from 82/164/171/203/208, 135/163/164/201/203/208, 162, 162/219/236, 162/219/313/338, 162/236/342, 162/313/342, and 164/171/201/203/282. In some embodiments, the engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 630 and one or more residue differences selected from 82A/164T/171M/203Q/208I, 135P/163D/164Q/201V/203Q/208I, 162S, 162S/219V/236L, 162S/219V/313C/338I, 162S/236L/342M, 162S/313C/342M, and 164Q/171M/201V/203Q/282V (relative to SEQ ID NO: 630). In some engineered polypeptide having proline hydroxylase activity with one or more improved properties as compared to SEQ ID NOs: 4, 116, 162, 322, 412, 492, 562, 598, and/or 630, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO: 630 and one or more residue differences selected from K82A/S164T/T171M/S203Q/L208I, S135P/Q163D/S164Q/A201V/S203Q/L208I, V162S, V162S/T219V/T236L, V162S/T219V/L313C/M338I, V162S/T236L/N342M, V162S/L313C/N342M, and S164Q/T171M/A201V/S203Q/L282V (relative to SEQ ID NO: 630).

As will be appreciated by the skilled artisan, in some embodiments, one or a combination of residue differences above that is selected can be kept constant (i.e., maintained) in the engineered proline hydroxylases as a core feature, and additional residue differences at other residue positions incorporated into the sequence to generate additional engineered proline hydroxylase polypeptides with improved properties. Accordingly, it is to be understood for any engineered proline hydroxylase containing one or a subset of the residue differences above, the present invention contemplates other engineered proline hydroxylases that comprise the one or subset of the residue differences, and additionally one or more residue differences at the other residue positions disclosed herein.

As noted above, the engineered polypeptides having proline hydroxylase activity are also capable of converting substrate compound L-proline to product compound trans-3-hydroxyproline. In some embodiments, the engineered proline hydroxylase polypeptide is capable of converting the substrate compound L-proline to product compound trans-3-hydroxyproline with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO: 4, 116, 162, 322, 412, 492, 562, 598, and/or 630. In some embodiments, the engineered proline hydroxylase polypeptide capable of converting the substrate compound L-proline to product compound trans-3-hydroxyproline with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO: 4, 116, 162, 322, 412, 492, 562, 598, and/or 630, comprises an amino acid sequence having one or more features selected from improved regioselectivity, improved activity, improved specific activity, and/or improved thermostability.

In some embodiments, the engineered proline hydroxylase polypeptide is capable of converting the substrate compound L-proline to product compound trans-3-hydroxyproline with at least 1.2 fold the activity relative to SEQ ID NO: 4, 116, 162, 322, 412, 492, 562, 598, and/or 630, and comprises an amino acid sequence selected from the even-numbered sequences in the following range: SEQ ID NO: 6-658.

In some embodiments, the engineered proline hydroxylase polypeptide is capable of converting the substrate compound L-proline to product compound trans-3-hydroxyproline with at least 2 fold the activity relative to SEQ ID NO: 4, 116, 162, 322, 412, 492, 562, 598, and/or 630, and comprises an amino acid sequence having one or more residue differences as provided herein (as compared to SEQ ID NO: 4, 116, 162, 322, 412, 492, 562, 598, and/or 630, as applicable).

In some embodiments, the engineered proline hydroxylase polypeptide capable of converting the substrate compound L-proline to product compound trans-3-hydroxyproline with at least 2 fold the activity relative to SEQ ID NO: 4, 116, 162, 322, 412, 492, 562, 598, and/or 630, comprises an amino acid sequence selected from: the even-numbered sequences in the following range: SEQ ID NO: 6-658.

In some embodiments, the engineered proline hydroxylase polypeptide is capable of converting at least 50% or more, 60% or more, 70% or more, 89% or more, 90% or more, 91% or more, 92% or more, 93% or more, 94% or more, or 95% or more of compound L-proline to product compound trans-3-hydroxyproline in 120 h or less, 72 h or less, 48 h or less, or 24 or less, at a substrate loading of about 100 g/L, about 50 g/L, or about 20 g/L under HTP assay conditions, under SFP assay conditions, or DSP assay conditions. In some embodiments, the engineered proline hydroxylase polypeptide is capable of converting at least 50% or more of compound L-proline to product compound trans-3-hydroxyproline in 24 h or less at a substrate loading of about 20 g/L under DSP Assay conditions at about 25° C.

In some embodiments, the engineered proline hydroxylase has an amino acid sequence comprising one or more residue differences as compared to SEQ ID NO: 4, 116, 162, 322, 412, 492, 562, 598, and/or 630, that increase expression of the engineered proline hydroxylase activity in a bacterial host cell, particularly in E. coli.

In some embodiments, the engineered proline hydroxylase polypeptide with improved properties in the conversion of compound L-proline to product compound trans-3-hydroxyproline has an amino acid sequence comprising a sequence selected from the even-numbered sequences in the following range: SEQ ID NO: 6-658.

In some embodiments, the engineered polypeptide having proline hydroxylase activity, comprises an amino acid sequence having at least 80%, 85%, 86%, 87%, 88%, 89%, 90%, 91%, 92%, 93%, 94%, 95%, 96%, 97%, 98%, or 99% identity to one of the even-numbered sequences in the following range: SEQ ID NO: 6-658, and the amino acid residue differences as compared to SEQ ID NO: 4, 116, 162, 322, 412, 492, 562, 598, and/or 630, present in any one of the even-numbered sequences in the following range: SEQ ID NO: 6-658, as provided in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1.

In addition to the residue positions specified above, any of the engineered proline hydroxylase polypeptides disclosed herein can further comprise other residue differences relative to SEQ ID NO: 4, 116, 162, 322, 412, 492, 562, 598, and/or 630, at other residue positions (i.e., residue positions other than those included in any of the even-numbered sequences in the following range: SEQ ID NO: 6-658). Residue differences at these other residue positions can provide for additional variations in the amino acid sequence without adversely affecting the ability of the polypeptide to carry out the conversion of proline to cis-4-hydroxyproline as well as conversion of compound L-proline to product compound trans-3-hydroxyproline. Accordingly, in some embodiments, in addition to the amino acid residue differences present in any one of the engineered proline hydroxylase polypeptides selected from the even-numbered sequences in the following range: SEQ ID NO: 6-658, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, or 1-50 residue differences at other amino acid residue positions as compared to the SEQ ID NO: 4, 116, 162, 322, 412, 492, 562, 598, and/or 630. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45 or 50 residue positions. In some embodiments, the number of amino acid residue differences as compared to the reference sequence can be 1, 2, 3, 4, 5, 6, 7, 8, 9, 10, 11, 12, 13, 14, 15, 16, 18, 20, 21, 22, 23, 24, or 25 residue positions. The residue difference at these other positions can be conservative changes or non-conservative changes. In some embodiments, the residue differences can comprise conservative substitutions and non-conservative substitutions as compared to the naturally occurring proline hydroxylase polypeptide of SEQ ID NO: 4, 116, 162, 322, 412, 492, 562, 598, and/or 630.

In some embodiments, the present invention also provides engineered polypeptides that comprise a fragment of any of the engineered proline hydroxylase polypeptides described herein that retains the functional activity and/or improved property of that engineered proline hydroxylase. Accordingly, in some embodiments, the present invention provides a polypeptide fragment capable of converting compound L-proline to product compound trans-3-hydroxyproline under suitable reaction conditions, wherein the fragment comprises at least about 80%, 90%, 95%, 96%, 97%, 98%, or 99% of a full-length amino acid sequence of an engineered proline hydroxylase polypeptide of the present invention, such as an exemplary engineered proline hydroxylase polypeptide selected from the even-numbered sequences in the following range: SEQ ID NO: 6-658.

In some embodiments, the engineered proline hydroxylase polypeptide can have an amino acid sequence comprising a deletion in any one of the engineered proline hydroxylase polypeptide sequences described herein, such as the exemplary engineered polypeptides of the even-numbered sequences in the following range: SEQ ID NO: 6-658. Thus, for each and every embodiment of the engineered proline hydroxylase polypeptides of the invention, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 20% of the total number of amino acids, or up to 30% of the total number of amino acids of the proline hydroxylase polypeptides, where the associated functional activity and/or improved properties of the engineered proline hydroxylase described herein are maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered proline hydroxylase polypeptide herein can have an amino acid sequence comprising an insertion as compared to any one of the engineered proline hydroxylase polypeptides described herein, such as the exemplary engineered polypeptides of the even-numbered sequences in the following range: SEQ ID NO: 6-658. Thus, for each and every embodiment of the proline hydroxylase polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered proline hydroxylase described herein is maintained. The insertions can be to amino or carboxy terminus, or internal portions of the proline hydroxylase polypeptide.

In some embodiments, the engineered proline hydroxylase polypeptide herein can have an amino acid sequence comprising a sequence selected from the even-numbered sequences in the following range: SEQ ID NO: 6-658, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1- 45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In the above embodiments, the suitable reaction conditions for the engineered polypeptides are provided as described in the Examples.

In some embodiments, the polypeptides of the present invention are fusion polypeptides in which the engineered polypeptides are fused to other polypeptides, such as, by way of example and not limitation, antibody tags (e.g., myc epitope), purification sequences (e.g., His-tags for binding to metals), and cell localization signals (e.g., secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally occurring and/or synthetic non-encoded amino acids. Certain commonly encountered non-encoded amino acids of which the polypeptides described herein may be comprised include, but are not limited to: the D-stereomers of the genetically-encoded amino acids; 2,3-diaminopropionic acid (Dpr); α-aminoisobutyric acid (Aib); s-aminohexanoic acid (Aha); 6-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aGly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (See e.g., the various amino acids provided in Fasman, *CRC Practical Handbook of Biochemistry and Molecular Biology*, CRC Press, Boca Raton, FL, pp. 3-70 [1989], and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(δ-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having proline hydroxylase activity of the present invention can be immobilized on a solid support such that they retain their improved activity, selectivity, and/or other improved properties relative to the reference polypeptide of SEQ ID NO: 4, 116, 162, 322, 412, 492, 562, 598, and/or 630. In such embodiments, the immobilized polypeptides can facilitate the biocatalytic conversion of the substrate compounds or other suitable substrates to the product and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the proline hydroxylase polypeptides of the present invention can be carried out using the same proline hydroxylase polypeptides bound or immobilized on a solid support.

Methods of enzyme immobilization are well-known in the art. The engineered polypeptides can be bound non-covalently or covalently. Various methods for conjugation and immobilization of enzymes to solid supports (e.g., resins, membranes, beads, glass, etc.) are well known in the art (See e.g., Yi et al., Proc. Biochem., 42(5): 895-898 [2007]; Martin et al., Appl. Microbiol. Biotechnol., 76(4): 843-851 [2007]; Koszelewski et al., J. Mol. Cat. B: Enzymatic, 63: 39-44 [2010]; Truppo et al., Org. Proc. Res. Dev., published online: dx.doi.org/10.1021/op200157c; Hermanson, *Bioconjugate Techniques*, $2^{nd}$ ed., Academic Press, Cambridge, MA [2008]; Mateo et al., Biotechnol. Prog., 18(3):629-34 [2002]; and "Bioconjugation Protocols: Strategies and Methods," In *Methods in Molecular Biology*, Niemeyer (ed.), Humana Press, New York, NY [2004]; the disclosures of each which are incorporated by reference herein). Solid supports useful for immobilizing the engineered proline hydroxylases of the present invention include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered proline hydroxylase polypeptides of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the polypeptides described herein are provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the kits of the present invention include arrays comprising a plurality of different proline hydroxylase polypeptides at different addressable position, wherein the different polypeptides are different variants of a reference sequence each having at least one different improved enzyme property. In some embodiments, a plurality of polypeptides immobilized on solid supports are configured on an array at various locations, addressable for robotic delivery of reagents, or by detection methods and/or instruments. The array can be used to test a variety of substrate compounds for conversion by the polypeptides. Such arrays comprising a plurality of engineered polypeptides and methods of their use are known in the art (See e.g., WO2009/008908A2).

Polynucleotides Encoding Engineered Proline Hydroxylases, Expression Vectors and Host Cells In another aspect, the present invention provides polynucleotides encoding the engineered proline hydroxylase polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered proline hydroxylase are introduced into appropriate host cells to express the corresponding proline hydroxylase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the improved proline hydroxylase enzymes. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the amino acid sequences presented in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1, and disclosed in the sequence listing incorporated by reference herein as the even-numbered sequences in the following range: SEQ ID NO: 6-658.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the proline hydroxylases since the natural sequence will comprise preferred codons and because use of preferred codons may not be required for all amino acid residues. Consequently, codon optimized polynucleotides encoding the proline hydroxylase enzymes may contain preferred codons at about 40%, 50%, 60%, 70%, 80%, or greater than 90% of codon positions of the full length coding region.

In some embodiments, the polynucleotide comprises a codon optimized nucleotide sequence encoding the naturally occurring proline hydroxylase polypeptide amino acid sequence, as represented by SEQ ID NO: 4, 116, 162, 322, 412, 492, 562, 598, and/or 630. In some embodiments, the polynucleotide has a nucleic acid sequence comprising at least 80%, 85%, 90%, 91%, 92%, 93%, 94%, 95%, 96%, 97%, 98%, 99% or more identity to the codon optimized nucleic acid sequences encoding the even-numbered sequences in the following range: SEQ ID NO: 6-658. In some embodiments, the polynucleotide has a nucleic acid sequence comprising at least 80%, 85%, 90%, 91%, 92%, 93%, 94%, 95%, 96%, 97%, 98%, 99% or more identity to the codon optimized nucleic acid sequences in the odd-numbered sequences in the following range: SEQ ID NO: 5-657. The codon optimized sequences of the odd-numbered sequences in the following range: SEQ ID NO: 5-657, enhance expression of the encoded, wild-type proline hydroxylase, providing preparations of enzyme capable of converting in vitro over 80% of compound L-proline to product compound trans-3-hydroxyproline under mini-DSP Assay conditions, and converting over 45% of compound L-proline to product compound trans-3-hydroxyproline under DSP Assay conditions. In some embodiments, the codon optimized polynucleotide sequence can enhance expression of the proline hydroxylase by at least 1.2 fold, 1.5 fold or 2 fold or greater as compared to the naturally occurring polynucleotide sequence of ANO from fungal sp. No. 11243.

In some embodiments, the polynucleotides are capable of hybridizing under highly stringent conditions to a reference sequence selected from the odd-numbered sequences in SEQ ID NOs: 3-657, or a complement thereof, and encodes a polypeptide having proline hydroxylase activity.

In some embodiments, as described above, the polynucleotide encodes an engineered polypeptide having proline hydroxylase activity with one or more improved properties as compared to SEQ ID NO: 4, 116, 162, 322, 412, 492, 562, 598, and/or 630, where the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO: 4, 116, 162, 322, 412, 492, 562, 598, and/or 630, and one or more residue differences as compared to SEQ ID NO: 4, 116, 162, 322, 412, 492, 562, 598, and/or 630, selected from the even-numbered sequences in the following range: SEQ ID NO: 6-658. In some embodiments, the reference amino acid sequence is selected from the even-numbered sequences in the following range: SEQ ID NO: 6-658. In some embodiments, the reference amino acid sequence is SEQ ID NO: 4. In some embodiments, the reference amino acid sequence is SEQ ID NO: 116. In some embodiments, the reference amino acid sequence is SEQ ID NO: 162. In some embodiments, the reference amino acid sequence is SEQ ID NO: 322. In some embodiments, the reference amino acid sequence is SEQ ID NO: 412. In some embodiments, the reference amino acid sequence is SEQ ID NO: 492. In some embodiments, the reference amino acid sequence is SEQ ID NO: 562. In some embodiments, the reference amino acid sequence is SEQ ID NO: 598. In some embodiments, the reference amino acid sequence is SEQ ID NO: 630.

In some embodiments, the polynucleotide encodes an engineered proline hydroxylase polypeptide capable of converting substrate compound L-proline to product compound trans-3-hydroxyproline with improved enzyme properties as compared to the reference polypeptide of SEQ ID NO: 4, 116, 162, 322, 412, 492, 562, 598, and/or 630, wherein the polypeptide comprises an amino acid sequence having at least 80%, 85%, 86%, 87%, 88%, 89%, 90%, 91%, 92%, 93%, 94%, 95%, 96%, 97%, 98%, or 99% identity to a reference polypeptide selected from any one of the even-numbered sequences in the range: SEQ ID NO: 6-658, with the proviso that the amino acid sequence comprises any one of the set of residue differences as compared to SEQ ID NO: 4, 116, 162, 322, 412, 492, 562, 598, and/or 630 contained in any one of the polypeptide sequences from the even-numbered sequences in the following range: SEQ ID NO: 6-658, as listed in Tables 4.1, 4.2, 4.3, 4.4, 5.1, 5.2, 5.3, 6.1, 7.1, 7.2, 7.3, 8.1, 8.2, 9.1, 9.2, 10.1, 10.2, 11.1, 11.2, and/or 12.1.

In some embodiments, the polynucleotide encoding the engineered proline hydroxylase comprises a polynucleotide sequence selected from the odd-numbered sequences in the following range: SEQ ID NO: 5-657.

In some embodiments, the polynucleotides are capable of hybridizing under highly stringent conditions to a reference polynucleotide sequence selected from the odd-numbered sequences in the following range: SEQ ID NO: 5-657, or a complement thereof, and encodes a polypeptide having proline hydroxylase activity with one or more of the improved properties described herein.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 4, and one or more residue differences as compared to SEQ ID NO: 4 at residue positions selected from 21, 28, 58/247, 65, 80, 85, 95, 98, 117, 120, 159, 185, 194, 199, 200, 233, 237, 243, 250, 268, 281, 282, 287, 289, 307, 324, 326, 327, 330, 338, 343, 346, and 348, or at residue positions selected from 21, 28, 45, 65, 95, 112, 117, 139, 177, 185, 199, 233, 243, 250, 281, 282, 287, 289, 307, 324, 326, 327, 335, 338, 343, and 346, or at residue positions selected from 48/66/189/194, 48/66/194, and 66/82/85/135/189/194/267, or at residue positions selected from 20/56/76/168/169/296, 20/56/232/294, 20/119/294/296, 56/76/119/124/147/232, 56/76/294, 76/168/232/294, 76/294/296, 76/296, 147, and 232.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 116, and one or more residue differences as compared to SEQ ID NO: 116 at residue positions selected from 123, 189, 195, 233, and 296, or at residue positions selected from 20/21/56, 20/21/56/76/ 95/232/294/307/335, 20/21/56/76/147/225/232/233/281/ 294/296/307/335, 20/21/56/95/147/281/294/307, 20/21/56/ 281/307, 20/21/76/232/243, 20/21/95/232/307, 20/21/95/ 281/294/296, 20/21/147/189/233/243/281/307, 20/56, 20/56/76/95/281/307, 20/56/76/147/294/296/307, 20/56/95/ 147/294, 20/56/281, 20/76, 20/76/95/281/294/296, 20/76/ 95/281/296/307, 20/76/233/294/307, 20/76/243/281/294, 21/76/147/233/294/307, 21/76/147/243/296/307/335, 21/95/185/189/232/281/296, 21/95/233/243/281/296, 21/95/294/296/307/335, 21/95/307, 21/281/307, 29/76/281, 56/76/95/232/243/281, 56/76/147/281/307, 56/76/243/294, 56/76/281/294, 56/76/296, 56/76/307, 56/95/147/307/335/ 348, 56/95/232/233/281/294/307, 56/95/243/281, 56/147/ 281, 56/232/243/281, 56/232/281, 56/232/281/294/296, 56/233/281/294/296, 56/281/307, 76/95/232/243/281/307, 76/95/243/281/307/335, 76/95/294/307, 76/147, 76/147/ 233/243/294, 76/147/233/281/294/307, 76/147/243/294/ 296/307/335, 76/147/281/307, 76/189/296, 76/232/233/243/ 294/296/307, 76/281, 76/281/294, 76/294/296, 95/120, 95/147/335, 95/232/243/281/294/307, 95/232/281/294/296, 95/281/294/296, 95/335, 147, 147/225/232/243/281/296/ 307/335, 147/233/243/281/307, 147/233/281/307/335, 147/ 243/281, 147/307, 232/233/281/294/296/307, 232/281, 232/

284/307, 233/243/281/296/307/335, 233/281/296/307, 243/281/294/296, 281, 281/294, 281/307, 307, and 335, or at residue positions selected from 21/76/147/243/296/307/335, 56/76/147/281/307, and 95/147/335.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 162, and one or more residue differences as compared to SEQ ID NO: 162 at residue positions selected from 2/85/123/237, 28/115/117/120/123/268/270/343/346/348, 45/123/326, 65/117/120/123/343/346, 85/123/281/282, 114/115/117/120/123/268/271/313/326/343/346, 123/139/233/237/281/282/289/324/326, and 123/199/200/247/250/338.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 322, and one or more residue differences as compared to SEQ ID NO: 322 at residue positions selected from 26, 54, 61, 129, 132, 149, 156, 175, 189, 201, 209, 228, 236, 248, 262, 272, 277, 291, and 345, or at residue positions selected from 25, 43, 54, 58, 61, 79, 129, 132, 143, 156, 163, 175, 179, 201, 209, 236, 248, 278, 291, 345, and 347, or at residue positions selected from 85/117/120/135/208/270/324/343/346, 85/117/120/135/208/281/282/289, 85/117/120/270/281/289, 85/117/135/139/208, and 117/120/208/270/324/343/346.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 412, and one or more residue differences as compared to SEQ ID NO: 412 at residue positions selected from 47, 48, 56/118, 85, 95, 95/289, 113, 118, 118/247, 154, 162, 162/204, 164, 164/198/271, 168, 169, 187, 195, 243, 271, 275, 281, 314, 330, and 342, or at residue positions selected from 25/129/163/236/262/345/347, 120/156/175/179/201, 129/189/236/262/277/278, 129/236/262, 156/175/179/228, and 162.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 492, and one or more residue differences as compared to SEQ ID NO: 492 at residue positions selected from 15, 17, 28, 29, 65, 135, 167, 177, 199, 208, 228, 235, 287, 294, 307, and 343, or at residue positions selected from 85/187/281/347, 85/187/347, 118/120/162/175/179/330, 118/120/162/175/330, 162/175/179/330, 175/228/330, 195/347, and 278/314/347.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 562, and one or more residue differences as compared to SEQ ID NO: 562 at residue positions selected from 15, 40, 43, 44, 59, 79, 82, 149, 164, 179, 345, and 347, or at residue positions selected from 29/85/177/208/228/347, 29/85/208/228/343/347, 29/177/195/228/343, 29/208/228/278/294/347, 56/195/278, 85/187/205/208/278, 113/177/187/195/208/278/294/343/347, and 177/205/208/228.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 598, and one or more residue differences as compared to SEQ ID NO: 598 at residue positions selected from 47, 162, 209, 219, 227, and 342, or at residue positions selected from 17/44/179/195/250/313/345, 17/44/199/313, 43/44/195/199, 44/149/164/171/187, 44/179/195/199, 44/179/195/199/345, 79/163/164/171/187/201/286/288, 82/163/164, 82/163/164/171/187/201/203/208/286/288/320, 149/164/171/288, and 187/286.

In some embodiments, the polynucleotide capable of hybridizing under highly stringent conditions encodes an engineered polypeptide having proline hydroxylase activity with one or more improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO: 630, and one or more residue differences as compared to SEQ ID NO: 630 at residue positions selected from 82/164/171/203/208, 135/163/164/201/203/208, 162, 162/219/236, 162/219/313/338, 162/236/342, 162/313/342, and 164/171/201/203/282.

In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered proline hydroxylase. In some embodiments, the reference polynucleotide sequence is selected from the odd-numbered sequences in the range SEQ ID NO: 3-657.

In some embodiments, an isolated polynucleotide encoding any of the engineered proline hydroxylase polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. For bacterial host cells, suitable promoters for directing transcription of the nucleic acid constructs of the present application, include, but are not limited to the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Bio., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered proline hydroxylase polypeptides provided herein. Effective signal peptide coding regions for bacterial host cells include, but are not limited to the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide. The propeptide coding region includes, but is not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention also provides a recombinant expression vector comprising a polynucleotide encoding an engineered proline hydroxylase polypeptide, and one or more expression regulating regions such as a promoter and a terminator, a replication origin, etc., depending on the type of hosts into which they are to be introduced. In some embodiments, the various nucleic acid and control sequences described above are combined together to produce a recombinant expression vector which includes one or more convenient restriction sites to allow for insertion or substitution of the nucleic acid sequence encoding the variant proline hydroxylase polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant proline hydroxylase polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered proline hydroxylase polypeptide of the present application, the polynucleotide being operatively linked to one or more control sequences for expression of the engineered proline hydroxylase enzyme(s) in the host cell. Host cells for use in expressing the polypeptides encoded by the expression vectors of the present invention are well known in the art and include but are not limited to, bacterial cells, such as *E. coli*, *Vibrio fluvialis*, *Streptomyces* and *Salmonella typhimurium* cells; fungal cells, such as yeast cells (e.g., *Saccharomyces cerevisiae* and *Pichia pastoris* [ATCC Accession No. 201178]); insect cells such as *Drosophila* S2 and *Spodoptera* Sf9 cells; animal cells such as CHO, COS, BHK, 293, and Bowes melanoma cells; and plant cells. Exemplary host cells are *Escherichia coli* strains (e.g., W3110 (ΔfhuA) and BL21).

Accordingly, in another aspect, the present invention provides methods for producing the engineered proline hydroxylase polypeptides, where the methods comprise culturing a host cell capable of expressing a polynucleotide encoding the engineered proline hydroxylase polypeptide under conditions suitable for expression of the polypeptide. In some embodiments, the methods further comprise the steps of isolating and/or purifying the proline hydroxylase polypeptides, as described herein.

Appropriate culture media and growth conditions for the above-described host cells are well known in the art. Polynucleotides for expression of the proline hydroxylase polypeptides may be introduced into cells by various methods known in the art. Techniques include, among others, electroporation, biolistic particle bombardment, liposome mediated transfection, calcium chloride transfection, and protoplast fusion.

The engineered proline hydroxylase with the properties disclosed herein can be obtained by subjecting the polynucleotide encoding the naturally occurring or engineered proline hydroxylase polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

In some embodiments, the engineered proline hydroxylases are obtained by subjecting the polynucleotide encoding the naturally occurring proline hydroxylase to mutagenesis and/or directed evolution methods, as discussed above. Mutagenesis may be performed in accordance with any of the techniques known in the art, including random and site-specific mutagenesis. Directed evolution can be performed with any of the techniques known in the art to screen for improved promoter variants including shuffling. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3: 284-290 [1999]; Christians et al., Nat. Biotechnol., 17: 259-264 [1999]; Crameri et al., Nature, 391: 288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme clones obtained following mutagenesis treatment are screened by subjecting the enzymes to a defined temperature (or other assay conditions, such as testing the enzyme's activity over a broad range of substrates) and measuring the amount of enzyme activity remaining after heat treatments or other assay conditions. Clones containing a polynucleotide encoding a proline hydroxylase polypeptide are then sequenced to identify the nucleotide sequence changes (if any) and used to express the enzyme in a host cell. Measuring enzyme activity from the expression libraries can be performed using any suitable method known in the art (e.g., standard biochemistry techniques, such as HPLC analysis).

In some embodiments, the clones obtained following mutagenesis treatment can be screened for engineered proline hydroxylases having one or more desired improved enzyme properties (e.g., improved regioselectivity). Measuring enzyme activity from the expression libraries can be performed using the standard biochemistry techniques, such as HPLC analysis and/or derivatization of products (pre or post separation), for example, using dansyl chloride or OPA (See e.g., Yaegaki et al., J Chromatogr. 356(1):163-70 [1986]).

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides encoding portions of the proline hydroxylase can be prepared by chemical synthesis as known in the art (e.g., the classical phosphoramidite method of Beaucage et al., Tet. Lett. 22:1859-69 [1981], or the method described by Matthes et al., EMBO J. 3:801-05 [1984]) as typically practiced in automated synthetic methods. According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources. In some embodiments, additional variations can be created by synthesizing oligonucleotides containing deletions, insertions, and/or substitutions, and combining the oligonucleotides in various permutations to create engineered proline hydroxylases with one or more improved properties.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO: 4-658, and having one or more residue differences as compared to SEQ ID NO: 4 at residue positions selected from: 21, 28, 58/247, 65, 80, 85, 95, 98, 117, 120, 159, 185, 194, 199, 200, 233, 237, 243, 250, 268, 281, 282, 287, 289, 307, 324, 326, 327, 330, 338, 343, 346, and 348; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO: 4-658, and having one or more residue differences as compared to SEQ ID NO: 4 at residue positions selected from: 21, 28, 45, 65, 95, 112, 117, 139, 177, 185, 199, 233, 243, 250, 281, 282, 287, 289, 307, 324, 326, 327, 335, 338, 343, and 346; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO: 4-658, and having one or more residue differences as compared to SEQ ID NO: 4 at residue positions selected from: 48/66/189/194, 48/66/194, and 66/82/85/135/189/194/267; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO: 4-658, and having one or more residue differences as compared to SEQ ID NO: 4 at residue positions selected from: 20/56/76/168/169/296, 20/56/232/294, 20/119/294/296, 56/76/119/124/147/232, 56/76/294, 76/168/232/294, 76/294/296, 76/296, 147, and 232; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO: 4-658, and having one or more residue differences as compared to SEQ ID NO: 116 at residue positions selected from 123, 189, 195, 233, and 296; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 116 at residue positions selected from: 20/21/56, 20/21/56/76/95/232/294/307/335, 20/21/56/76/147/225/232/233/281/294/296/307/335, 20/21/56/95/147/281/294/307, 20/21/56/281/307, 20/21/76/232/243, 20/21/95/232/307, 20/21/95/281/294/296, 20/21/147/189/233/243/281/307, 20/56, 20/56/76/95/281/307, 20/56/76/147/294/296/307, 20/56/95/147/294, 20/56/281, 20/76, 20/76/95/281/294/296, 20/76/95/281/296/307, 20/76/233/294/307, 20/76/243/281/294, 21/76/147/233/294/307, 21/76/147/243/296/307/335, 21/95/185/189/232/281/296, 21/95/233/243/281/296, 21/95/294/296/307/335, 21/95/307, 21/281/307, 29/76/281, 56/76/95/232/243/281, 56/76/147/281/307, 56/76/243/294, 56/76/281/294, 56/76/296, 56/76/307, 56/95/147/307/335/348, 56/95/232/233/281/294/307, 56/95/243/281, 56/147/281, 56/232/243/281, 56/232/281, 56/232/281/294/296, 56/233/281/294/296, 56/281/307, 76/95/232/243/281/307, 76/95/243/281/307/335, 76/95/294/307, 76/147, 76/147/233/243/294, 76/147/233/281/294/307, 76/147/243/294/296/307/335, 76/147/281/307, 76/189/296, 76/232/233/243/294/296/307, 76/281, 76/281/294, 76/294/296, 95/120, 95/147/335, 95/232/243/281/294/307, 95/232/281/294/296, 95/281/294/296, 95/335, 147, 147/225/232/243/281/296/307/335, 147/233/243/281/307, 147/233/281/307/335, 147/243/281, 147/307, 232/233/281/294/296/307, 232/281, 232/284/307, 233/243/281/296/307/335, 233/281/296/307, 243/281/294/296, 281, 281/294, 281/307, 307, and 335; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 116 at residue positions selected from: 21/76/147/243/296/307/335, 56/76/147/281/307, and 95/147/335; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 162 at residue positions selected from: 2/85/123/237, 28/115/117/120/123/268/270/343/346/348, 45/123/326, 65/117/120/123/343/346, 85/123/281/282, 114/115/117/120/123/268/271/313/326/343/346, 123/139/233/237/281/282/289/324/326, and 123/199/200/247/250/338; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 322 at residue positions selected from: 26, 54, 61, 129, 132, 149, 156, 175, 189, 201, 209, 228, 236, 248, 262, 272, 277, 291, and 345; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 322 at residue positions selected from: 25, 43, 54, 58, 61, 79, 129, 132, 143, 156, 163, 175, 179, 201, 209, 236, 248, 278, 291, 345, and 347; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 322 at residue positions selected from: 85/117/120/135/208/270/324/343/346, 85/117/120/135/208/281/282/289, 85/117/120/270/281/289, 85/117/135/139/208, and 117/120/208/270/324/343/346; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 412 at residue positions selected from: 47, 48, 56/118, 85, 95, 95/289, 113, 118, 118/247, 154, 162, 162/204, 164, 164/198/271, 168, 169, 187, 195, 243, 271, 275, 281, 314, 330, and 342; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 412 at residue positions selected from: 25/129/163/236/262/345/347, 120/156/175/179/201, 129/189/236/262/277/278, 129/236/262, 156/175/179/228, and 162; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 492 at residue positions selected from: 15, 17, 28, 29, 65, 135, 167, 177, 199, 208, 228, 235, 287, 294, 307, and 343; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 492 at residue positions selected from: 85/187/281/347, 85/187/347, 118/120/162/175/179/330, 118/120/162/175/330, 162/175/179/330, 175/228/330, 195/347, and 278/314/347; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 562 at residue positions selected from: 15, 40, 43, 44, 59, 79, 82, 149, 164, 179, 345, and 347; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 562 at residue positions selected from: 29/85/177/208/228/347, 29/85/208/228/343/347, 29/177/195/228/343, 29/208/228/278/294/347, 56/195/278, 85/187/205/208/278, 113/177/187/195/208/278/294/343/347, and 177/205/208/228; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 598 at residue positions selected from 47, 162, 209, 219, 227, and 342; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 598 at residue positions selected from 17/44/179/195/250/313/345, 17/44/199/313, 43/44/195/199, 44/149/164/171/187, 44/179/195/199, 44/179/195/199/345, 79/163/164/171/187/201/286/288, 82/163/164, 82/163/164/171/187/201/203/208/286/288/320, 149/164/171/288, and 187/286; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO: 4-658, and having one or more residue differences as compared to SEQ ID NO: 630 at residue positions selected from 82/164/171/203/208, 135/163/164/201/203/208, 162, 162/219/236, 162/219/313/338, 162/236/342, 162/313/342, and 164/171/201/203/282; and (b) expressing the proline hydroxylase polypeptide encoded by the polynucleotide.

In some embodiments of the method, the polynucleotide encodes an engineered proline hydroxylase that has optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1- 45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In some embodiments, any of the engineered proline hydroxylase enzymes expressed in a host cell can be recovered from the cells and/or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available (e.g., CelLytic B™ Sigma-Aldrich, St. Louis MO).

Chromatographic techniques for isolation of the proline hydroxylase polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved proline hydroxylase enzymes. For affinity chromatography purification, any antibody which specifically binds the proline hydroxylase polypeptide may be used. For the production of antibodies, various host animals, including but not limited to rabbits, mice, rats, etc., may be immunized by injection with a proline hydroxylase polypeptide, or a fragment thereof. The proline hydroxylase polypeptide or fragment may be attached to a suitable carrier, such as BSA, by means of a side chain functional group or linkers attached to a side chain functional group. In some embodiments, the affinity purification can use a specific ligand bound by the proline hydroxylase, such as poly(L-proline) or dye affinity column (See e.g., EP0641862; Stellwagen, "Dye Affinity Chromatography," In *Current Protocols in Protein Science*, Unit 9.2-9.2.16 [2001]).

Methods of Using the Engineered Proline Hydroxylase Enzymes

In some embodiments, the proline hydroxylases described herein find use processes for converting a suitable substrate to its hydroxylated product. Generally, the process for performing the hydroxylation reaction comprises contacting or incubating the substrate compound in presence of a co-substrate, such as α-ketoglutarate, with a proline hydroxylase polypeptide of the invention under reaction conditions suitable for formation of the hydroxylated product, as shown in Scheme 1, above.

In the embodiments provided herein and illustrated in the Examples, various ranges of suitable reaction conditions that can be used in the processes, include but are not limited to, substrate loading, co-substrate loading, reductant, divalent transition metal, pH, temperature, buffer, solvent system, polypeptide loading, and reaction time. Further suitable reaction conditions for carrying out the process for biocatalytic conversion of substrate compounds to product compounds using an engineered proline hydroxylase polypeptide described herein can be readily optimized in view of the guidance provided herein by routine experimentation that includes, but is not limited to, contacting the engineered proline hydroxylase polypeptide and substrate compound under experimental reaction conditions of concentration, pH, temperature, and solvent conditions, and detecting the product compound.

Suitable reaction conditions using the engineered proline hydroxylase polypeptides typically comprise a co-substrate, which is used stoichiometrically in the hydroxylation reaction. Generally, the co-substrate for proline hydroxylases is α-ketoglutarate, also referred to as α-ketoglutaric acid and 2-oxoglutaric acid. Other analogs of α-ketoglutarate that are capable of serving as co-substrates for proline hydroxylases can be used. An exemplary analog that may serve as a co-substrate is α-oxoadipate. Because the co-substrate is used stoichiometrically, the co-substrate is present at an equimolar or higher amount than that of the substrate compound (i.e., the molar concentration of co-substrate is equivalent to or higher than the molar concentration of substrate compound). In some embodiments, the suitable reaction conditions can comprise a co-substrate molar concentration of at least 1 fold, 1.5 fold, 2 fold, 3 fold 4 fold or 5 fold or more than the molar concentration of the substrate compound. In some embodiments, the suitable reaction conditions can comprise a co-substrate concentration, particularly alpha-ketoglutarate, of about 0.001 M to about 2 M, 0.01 M to about 2 M, 0.1 M to about 2 M, 0.2 M to about 2 M, about 0.5 M to about 2 M, or about 1 M to about 2 M. In some embodiments, the reaction conditions comprise a co-substrate concentration of about 0.001, 0.01, 0.1, 0.2, 0.3, 0.4, 0.5, 0.6, 0.7, 0.8, 1, 1.5, or 2 M. In some embodiments, additional co-substrate can be added during the reaction.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments, the suitable reaction conditions comprise a substrate compound loading of at least about 0.5 to about 200 g/L, 1 to about 200 g/L, 5 to about 150 g/L, about 10 to about 100 g/L, 20 to about 100 g/L or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of L-proline, however it also contemplated that the equivalent molar amounts of various hydrates and salts of L-proline also can be used in the process.

In carrying out the proline hydroxylase mediated processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered proline hydroxylase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization (e.g., ultrafiltration, dialysis, etc.). Any of the enzyme preparations (including whole cell preparations) may be stabilized by crosslinking using known crosslinking agents, such as, for example, glutaraldehyde or immobilization to a solid phase (e.g., Eupergit C, and the like).

The gene(s) encoding the engineered proline hydroxylase polypeptides can be transformed into host cells separately or together into the same host cell. For example, in some embodiments one set of host cells can be transformed with gene(s) encoding one engineered proline hydroxylase polypeptide and another set can be transformed with gene(s) encoding another engineered proline hydroxylase polypeptide. Both sets of transformed cells can be utilized together in the reaction mixture in the form of whole cells, or in the form of lysates or extracts derived therefrom. In other embodiments, a host cell can be transformed with gene(s) encoding multiple engineered proline hydroxylase polypeptide. In some embodiments the engineered polypeptides can be expressed in the form of secreted polypeptides, and the culture medium containing the secreted polypeptides can be used for the proline hydroxylase reaction.

In some embodiments, the improved activity and/or selectivity of the engineered proline hydroxylase polypeptides disclosed herein provides for processes wherein higher percentage conversion can be achieved with lower concentrations of the engineered polypeptide. In some embodiments of the process, the suitable reaction conditions comprise an engineered polypeptide amount of about 1% (w/w), 2% (w/w), 5% (w/w), 10% (w/w), 20% (w/w), 30% (w/w), 40% (w/w), 50% (w/w), 75% (w/w), 100% (w/w) or more of substrate compound loading.

In some embodiments, the engineered polypeptide is present at about 0.01 g/L to about 50 g/L; about 0.05 g/L to about 50 g/L; about 0.1 g/L to about 40 g/L; about 1 g/L to about 40 g/L; about 2 g/L to about 40 g/L; about 5 g/L to about 40 g/L; about 5 g/L to about 30 g/L; about 0.1 g/L to about 10 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the proline hydroxylase polypeptide is present at about 0.01 g/L, 0.05 g/L, 0.1 g/L, 0.2 g/L, 0.5 g/L, 1, 2 g/L, 5 g/L, 10 g/L, 15 g/L, 20 g/L, 25 g/L, 30 g/L, 35 g/L, 40 g/L, or 50 g/L.

In some embodiments, the reactions conditions also comprise a divalent transition metal capable of serving as a cofactor in the oxidation reaction. Generally, the divalent transition metal co-factor is ferrous ion (i.e., $Fe^{+2}$). The ferrous ion may be provided in various forms, such as ferrous sulfate ($FeSO_4$), ferrous chloride ($FeCl_2$), ferrous carbonate ($FeCO_3$), and the salts of organic acids such as citrates, lactates and fumarates. An exemplary source of ferrous sulfate is Mohr's salt, which is ferrous ammonium sulfate $(NH_4)_2Fe(SO_4)_2$ and is available in anhydrous and hydrated (i.e., hexahydrate) forms. While ferrous ion is the transition metal co-factor found in the naturally occurring proline hydroxylase and functions efficiently in the engineered enzymes, it is to be understood that other divalent transition metals capable of acting as a co-factor can be used in the processes. In some embodiments, the divalent transition metal co-factor can comprise $Mn^{+2}$ and $Cr^{+2}$. In some embodiments, the reaction conditions can comprises a divalent transition metal cofactor, particularly $Fe^{+2}$, at a concentration of about 0.1 mM to 10 mM, 0.1 mM to about 5 mM, 0.5 mM to about 5 mM, about 0.5 mM to about 3 mM or about 1 mM to about 2 mM. In some embodiments, the reaction conditions comprise a divalent transition metal co-factor concentration of about 0.1 mM, 0.2 mM, 0.5 mM, 1 mM, 1.5 mM, 2 mM, 3 mM, 5 mM, 7.5 mM or 10 mM. In some embodiments, higher concentrations of divalent transition metal cofactor can be used, for example up to 50 mM or up to 100 mM.

In some embodiments, the reaction conditions can further comprise a reductant capable of reducing ferric ion, $Fe^{+3}$ to ferrous ion, $Fe^{+2}$. In some embodiments, the reductant comprises ascorbic acid, typically L-ascorbic acid. While ascorbic acid is not required for the hydroxylation reaction, enzymatic activity is enhanced in its presence. Without being bound by theory, the ascorbate is believed to maintain or regenerate the enzyme-$Fe^{+2}$ form, which is the active form mediating the hydroxylation reaction. Generally, the reaction conditions can comprise an ascorbic acid concentration that corresponds proportionately to the substrate loading. In some embodiments, the ascorbic acid is present in at least about 0.1 fold, 0.2 fold 0.3 fold, 0.5 fold, 0.75 fold, 1 fold, 1.5 fold, or at least 2 fold the molar amount of substrate. In some embodiments, the reductant, particularly L-ascorbic acid, is at a concentration of about 0.001 M to about 0.5 M, about 0.01M to about 0.5 M, about 0.01 M to about 0.4 M, about 0.1 to about 0.4 M, or about 0.1 to about 0.3 M. In some embodiments, the reductant, particularly ascorbic acid, is at a concentration of about 0.001 M, 0.005 M, 0.01 M, 0.02M, 0.03 M, 0.05 M, 0.1 M, 0.15 M, 0.2 M, 0.3 M, 0.4 M, or 0.5 M.

In some embodiments, the reaction conditions comprise molecular oxygen (i.e., 02). Without being bound by theory, one atom of oxygen from molecular oxygen is incorporated into the substrate compound to form the hydroxylated product compound. The 02 may be present naturally in the reaction solution, or introduced and/or supplemented into the reaction artificially. In some embodiments, the reaction conditions can comprise forced aeration (e.g., sparging) with air, 02 gas, or other 02-containing gases. In some embodiments, the 02 in the reaction can be increased by increasing the pressure of the reaction with 02 or an 02-containing gas. This can be done by carrying out the reaction in a vessel that can be pressurized with 02 gas. In some embodiments, the 02 gas can be sparged through the reaction solution at a rate of at least 1 liter per hour (L/h), at least 2 L/h, at least 3 L/h, at least 4 L/h, at least 5 L/h, or greater. In some embodiments, the 02 gas can be sparged through the reaction solution at a rate of between about 1 L/h and 10 L/h, between about 2 L/h and 7 L/h, or between about 3 L/h and 5 L/h.

During the course of the reaction, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine, and 2-amino-2-hydroxymethyl-propane-1,3-diol (Tris), and the like. In some embodiments, the buffer is phosphate. In some embodiments of the process, the suitable reaction conditions comprise a buffer (e.g., phosphate) concentration of from about 0.01 to about 0.4 M, 0.05 to about 0.4 M, 0.1 to about 0.3 M, or about 0.1 to about 0.2 M. In some embodiments, the reaction condition comprises a buffer (e.g., phosphate) concentration of about 0.01, 0.02, 0.03, 0.04, 0.05, 0.07, 0.1, 0.12, 0.14, 0.16, 0.18, 0.2, 0.3, or 0.4 M. In some embodiments, the reaction conditions comprise water as a suitable solvent with no buffer present.

In the embodiments of the process, the reaction conditions can comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature can be used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 60° C., about 10° C. to about 55° C., about 15° C. to about 60° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

The processes of the invention are generally carried out in a solvent. Suitable solvents include water, aqueous buffer solutions, organic solvents, polymeric solvents, and/or co-solvent systems, which generally comprise aqueous solvents, organic solvents and/or polymeric solvents. The aqueous solvent (water or aqueous co-solvent system) may be pH-buffered or unbuffered. In some embodiments, the processes using the engineered proline hydroxylase polypeptides can be carried out in an aqueous co-solvent system comprising an organic solvent (e.g., ethanol, isopropanol (IPA), dimethyl sulfoxide (DMSO), dimethylformamide (DMF) ethyl acetate, butyl acetate, 1-octanol, heptane, octane, methyl t butyl ether (MTBE), toluene, and the like), ionic or polar solvents (e.g., 1-ethyl 4 methylimidazolium tetrafluoroborate, 1-butyl-3-methylimidazolium tetrafluoroborate, 1-butyl 3 methylimidazolium hexafluorophosphate, glycerol, polyethylene glycol, and the like). In some embodiments, the co-solvent can be a polar solvent, such as a polyol, dimethylsulfoxide (DMSO), or lower alcohol. The non-aqueous co-solvent component of an aqueous co-solvent system may be miscible with the aqueous component, providing a single liquid phase, or may be partly miscible or immiscible with the aqueous component, providing two liquid phases. Exemplary aqueous co-solvent systems can comprise water and one or more co-solvents selected from an organic solvent, polar solvent, and polyol solvent. In general, the co-solvent component of an aqueous co-solvent system is chosen such that it does not adversely inactivate the proline hydroxylase enzyme under the reaction conditions. Appropriate co-solvent systems can be readily identified by measuring the enzymatic activity of the specified engineered proline hydroxylase enzyme with a defined substrate of interest in the candidate solvent system, utilizing an enzyme activity assay, such as those described herein.

In some embodiments of the process, the suitable reaction conditions comprise an aqueous co-solvent, where the co-solvent comprises DMSO at about 1% to about 50% (v/v), about 1 to about 40% (v/v), about 2% to about 40% (v/v), about 5% to about 30% (v/v), about 10% to about 30% (v/v), or about 10% to about 20% (v/v). In some embodiments of the process, the suitable reaction conditions can comprise an aqueous co-solvent comprising DMSO at about 1% (v/v), about 5% (v/v), about 10% (v/v), about 15% (v/v), about 20% (v/v), about 25% (v/v), about 30% (v/v), about 35% (v/v), about 40% (v/v), about 45% (v/v), or about 50% (v/v).

In some embodiments, the reaction conditions can comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypoly-ethoxylethanol (NP40), Triton X-100, polyoxyethylene-stearylamine, cetyltrimethylammonium bromide, sodium oleylamidosulfate, polyoxyethylene-sorbitanmonostearate, hexadecyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions can include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include, Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the hydroxylase reaction will generally vary depending on the quantities of product desired, and concomitantly the amount of proline hydroxylase substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate, proline hydroxylase, and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the proline hydroxylase, and cofactor may be added and mixed into the aqueous phase first. The organic phase may then be added and mixed in, followed by addition of the proline hydroxylase substrate and co-substrate. Alternatively, the proline hydroxylase substrate may be premixed in the organic phase, prior to addition to the aqueous phase.

The hydroxylation process is generally allowed to proceed until further conversion of substrate to hydroxylated product does not change significantly with reaction time (e.g., less than 10% of substrate being converted, or less than 5% of substrate being converted). In some embodiments, the reaction is allowed to proceed until there is complete or near complete conversion of substrate to product. Transformation of substrate to product can be monitored using known methods by detecting substrate and/or product, with or without derivatization. Suitable analytical methods include gas chromatography, HPLC, MS, and the like.

In some embodiments of the process, the suitable reaction conditions comprise a substrate loading of at least about 5 g/L, 10 g/L, 20 g/L, 30 g/L, 40 g/L, 50 g/L, 60 g/L, 70 g/L, 100 g/L, or more, and wherein the method results in at least about 50%, 60%, 70%, 80%, 90%, 95% or greater conversion of substrate compound to product compound in about 48 h or less, in about 36 h or less, or in about 24 h or less.

The engineered proline hydroxylase polypeptides of the present invention when used in the process under suitable reaction conditions result in an excess of the trans-3-hydroxylated product in at least 90%, 95%, 96%, 97%, 98%, 99%, or greater isomeric excess over the trans-4-hydroxylated product. In some embodiments, no detectable amount of compound trans-4-hydroxylated product is formed.

In further embodiments of the processes for converting substrate compound to hydroxylated product compound using the engineered proline hydroxylase polypeptides, the suitable reaction conditions can comprise an initial substrate loading to the reaction solution which is then contacted by the polypeptide. This reaction solution is then further supplemented with additional substrate compound as a continuous or batchwise addition over time at a rate of at least about 1 g/L/h, at least about 2 g/L/h, at least about 4 g/L/h, at least about 6 g/L/h, or higher. Thus, according to these suitable reaction conditions, polypeptide is added to a solution having an initial substrate loading of at least about 20 g/L, 30 g/L, or 40 g/L. This addition of polypeptide is then followed by continuous addition of further substrate to the solution at a rate of about 2 g/L/h, 4 g/L/h, or 6 g/L/h until a much higher final substrate loading of at least about 30 g/L, 40 g/L, 50 g/L, 60 g/L, 70 g/L, 100 g/L, 150 g/L, 200 g/L or more, is reached. Accordingly, in some embodiments of the process, the suitable reaction conditions comprise addition of the polypeptide to a solution having an initial substrate loading of at least about 20 g/L, 30 g/L, or 40 g/L followed by addition of further substrate to the solution at a rate of about 2 g/L/h, 4 g/L/h, or 6 g/L/h until a final substrate loading of at least about 30 g/L, 40 g/L, 50 g/L, 60 g/L, 70 g/L, 100 g/L or more, is reached. This substrate supplementation reaction condition allows for higher substrate loadings to be achieved while maintaining high rates of conversion of substrate to hydroxylated product of at least about 50%, 60%, 70%, 80%, 90% or greater conversion of substrate. In some embodiments of this process, the substrate added is in a solution comprising α-ketoglutarate at an equimolar or higher amount of the further added substrate.

In some embodiments of the processes, the reaction using an engineered proline hydroxylase polypeptide can comprise the following suitable reaction conditions: (a) substrate loading at about 60 g/L; (b) about 6 g/L of the engineered polypeptide; (c) α-ketoglutarate at about 1.2 molar equivalents of substrate compound; (d) about 10 mM ascorbic acid; (e) about 4 mM $FeSO_4$; (f) a pH of about 6.8; (g) temperature of about 20° C.; and (h) reaction time of about 24 h.

In some embodiments, additional reaction components or additional techniques are carried out to supplement the reaction conditions. These can include taking measures to stabilize or prevent inactivation of the enzyme, reduce product inhibition, shift reaction equilibrium to hydroxylated product formation.

In further embodiments, any of the above described process for the conversion of substrate compound to product compound can further comprise one or more steps selected from: extraction; isolation; purification; and crystallization of product compound. Methods, techniques, and protocols for extracting, isolating, purifying, and/or crystallizing the hydroxylated product from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); NA (nucleic acid; polynucleotide); AA (amino acid; polypeptide); E. coli W3110 (commonly used laboratory E. coli strain, available from the Coli Genetic Stock Center [CGSC], New Haven, CT); HPLC (high pressure liquid chromatography); SDS-PAGE (sodium dodecyl sulfate polyacrylamide gel electrophoresis); PES (polyethersulfone); CFSE (carboxyfluorescein succinimidyl ester); IPTG (isopropyl beta-D-1-thiogalactopyranoside); PMBS (polymyxin B sulfate); NADPH (nicotinamide adenine dinucleotide phosphate); GDH (glucose dehydrogenase); polyethylenimine (PEI); FIOPC (fold improvement over positive control); DO (dissolved oxygen); ESI (electrospray ionization); LB (Luria broth); TB (terrific broth); MeOH (methanol); HTP (high throughput); SFP (shake flask powder); DSP (downstream process powder); Athens Research (Athens Research Technology, Athens, GA); ProSpec (ProSpec Tany Technogene, East Brunswick, NJ); Sigma-Aldrich (Sigma-Aldrich, St. Louis, MO); Ram Scientific (Ram Scientific, Inc., Yonkers, NY); Pall Corp. (Pall, Corp., Pt. Washington, NY); Millipore (Millipore, Corp., Billerica MA); Difco (Difco Laboratories, BD Diagnostic Systems, Detroit, MI); Molecular Devices (Molecular Devices, LLC, Sunnyvale, CA); Kuhner (Adolf Kuhner, AG, Basel, Switzerland); Cambridge Isotope Laboratories, (Cambridge Isotope Laboratories, Inc., Tewksbury, MA); Applied Biosystems (Applied Biosystems, part of Life Technologies, Corp., Grand Island, NY), Agilent (Agilent Technologies, Inc., Santa Clara, CA); Thermo Scientific (part of Thermo Fisher Scientific, Waltham, MA); Fisher (Fisher Scientific, Waltham, MA); Corning (Corning, Inc., Palo Alto, CA); Waters (Waters Corp., Milford, MA); GE Healthcare (GE Healthcare Bio-Sciences, Piscataway, NJ); Pierce (Pierce Biotechnology (now part of Thermo Fisher Scientific), Rockford, IL); Phenomenex (Phenomenex, Inc., Torrance, CA); Optimal (Optimal Biotech Group, Belmont, CA); and Bio-Rad (Bio-Rad Laboratories, Hercules, CA).

Example 1

E. coli Expression Hosts Containing Recombinant Proline Hydroxylase Genes

The initial proline hydroxylase (PH) enzyme used to produce the variants of the present invention was obtained from the wild-type ANO sequence from fungal sp. No. 11243 (Accession number GAM84982). The wild type PH protein sequence was codon optimized for expression in E. coli, and the DNA was cloned into the expression vector pCK110900 (See, FIG. 3 of US Pat. Appln. Publn. No. 2006/0195947), operatively linked to the lac promoter under control of the lacI repressor. The expression vector also contains the P15a origin of replication and a chloramphenicol resistance gene. The resulting plasmids were transformed into E. coli W3110, using standard methods known in the art. The transformants were isolated by subjecting the cells to chloramphenicol selection, as known in the art (See e.g., U.S. Pat. No. 8,383,346 and WO2010/144103).

Example 2

Preparation of HTP PH-Containing Wet Cell Pellets and Lysate

E. coli cells containing recombinant PH-encoding genes from monoclonal colonies were inoculated into 180 μl LB containing 1% glucose and 30 μg/mL chloramphenicol (CAM) in the wells of 96-well shallow-well microtiter plates. The plates were sealed with $O_2$-permeable seals, and the cultures were grown overnight at 30° C., 200 rpm, and 85% humidity. Then, 10 μl of each of the cell cultures were transferred into the wells of 96-well deep-well plates containing 390 mL TB and 30 μg/mL CAM. The deep-well plates were sealed with $O_2$-permeable seals and incubated at 30° C., 250 rpm, and 85% humidity until $OD_{600}$ 0.6-0.8 was reached. The cell cultures were then induced by IPTG to a final concentration of 1 mM and incubated overnight at 20° C. or 30° C. The cells were then pelleted using centrifugation at 4000 rpm for 10 min. The supernatants were discarded and the pellets frozen at −80° C. prior to lysis.

For lysis, 400 μl lysis buffer containing 50 mM sodium phosphate buffer, pH 6.5, 1 g/L lysozyme, and 0.5 g/L polymyxin b sulfate (PMBS) was added to the cell paste in each well produced as described in Example 2. The cells were lysed at room temperature for 2 hours with shaking on a bench top shaker. The plate was then centrifuged for 15 min at 4000 rpm and 4° C. The clear supernatants were then used in biocatalytic reactions to determine their activity levels.

Example 3

Preparation of Lyophilized Lysates from Shake Flask (SF) Cultures

Selected HTP cultures grown as described above were plated onto LB agar plates with 1% glucose and 30 μg/ml CAM and grown overnight at 37° C. A single colony from each culture was transferred to 6 ml of LB with 1% glucose and 30 μg/ml CAM. The cultures were grown for 18 h at 30° C., 250 rpm, and subcultured approximately 1:50 into 250 ml of TB containing 30 μg/ml CAM, to a final $OD_{600}$ of 0.05. The cultures were grown for approximately 195 minutes at 30° C., 250 rpm, to an $OD_{600}$ between 0.6-0.8 and induced with 1 mM IPTG. The cultures were then grown for 20 h at 20° C. or 30° C., 250 rpm. The cultures were centrifuged 4000 rpm for 20 min. The supernatant was discarded, and the pellets were resuspended in 30 ml of 20 mM Triethanolamine, pH 7.5, and lysed using a Microfluidizer® processor system (Microfluidics) at 18,000 psi. The lysates were pelleted (10,000 rpm for 60 min), and the supernatants were frozen and lyophilized to generate shake flake (SF) enzymes.

Example 4

Improvements Over SEQ ID NO: 4 in the Conversion of Proline Substrate to Trans-3-Hydroxyproline SEQ ID NO: 4 was selected as the parent enzyme based on the results of screening variants for the conversion of the L-proline substrate to trans-3-hydroxyproline. SEQ ID NO: 4 is identical to SEQ ID NO: 2; both sequences are the wild-type proline hydroxylase to which an N-terminal his-tag has been added, while SEQ ID NO: 3 is the codon-optimized polynucleotide encoding the wild-type proline hydroxylase. Libraries of engineered genes were produced using well-established techniques (e.g., saturation mutagenesis, and recombination of previously identified beneficial mutations). The polypeptides encoded by each gene were produced in HTP as described in Example 2 (with protein expression overnight at 20° C.). For all variants, the cell pellets were lysed by adding 200 μL lysis buffer (containing 50 mM sodium phosphate buffer pH 6.5, 1 g/L lysozyme, and 0.5 g/L PMBS) and shaking at room temperature for 2 hours on a table top shaker. The plates were centrifuged at 4000 rpm for 15 minutes at 4° C. to remove cell debris.

In a 300 μL round bottom plate, 50 μL of the E. coli lysates were added to 200 μL of reaction mix (comprising 75 μL of 63 g/L α-ketoglutaric acid [in 50 mM sodium phosphate pH 6.5], 50 μL of 20 mM Mohr's salt in 65 mM ascorbic acid [in 50 mM sodium phosphate pH 6.5], and 75 μL of 33 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 μL of the reaction mix into a 96-well deep-well plate containing 225 μL derivatization solution (comprising 75 μL of saturated sodium bicarbonate, 25 μL water, and 125 μL of 2.5 mg/mL FmocCl [in ACN] per well). After 1 hr of shaking at room temperature, the plate was centrifuged for one minute at 4000 rpm, and 40 μL of the soluble fraction of the quenched reaction were mixed with 160 μL of 1:1 ACN: 0.5M HCl. The derivatized and diluted samples were analyzed as described in Table 13.1. Selectivity relative to SEQ ID NO: 4 (Selectivity FIOP) was calculated as the ratio of trans-3-hydroxyproline: trans-4-hydroxyproline of the product formed by the variant over the ratio produced by SEQ ID NO: 4. Activity relative to SEQ ID NO:4 (Activity FIOP) was calculated as the ratio of the peak area of trans-3-hydroxyproline of the variant compared with the peak area of trans-3-hydroxyproline produced by SEQ ID NO: 4. The results are shown in Tables 4.1 and 4.2.

TABLE 4.1

Selectivity of Variants Relative to SEQ ID NO: 4

| SEQ ID NO: (nt/aa) | Amino Acid Differences (Relative to SEQ ID NO: 4) | FIOP [1] (Selectivity ratio) (Relative to SEQ ID NO: 4) |
|---|---|---|
| 5/6 | N194L | +++ |
| 7/8 | N194T | ++ |
| 9/10 | V233R | + |
| 11/12 | A117T | + |
| 13/14 | G95P | + |
| 15/16 | Q348S | + |
| 17/18 | A117L | + |
| 19/20 | V233A | + |
| 21/22 | D287E | + |
| 23/24 | L330G | + |
| 25/26 | A117R | + |
| 27/28 | K80H | + |
| 29/30 | A117E | + |
| 31/32 | Q98L | + |
| 33/34 | M338I | + |
| 35/36 | L282E | + |
| 37/38 | T199A | + |
| 39/40 | Q159G | + |
| 41/42 | L243V | + |
| 43/44 | L282S | + |
| 45/46 | E58V;P247V | + |
| 47/48 | A117S | + |
| 49/50 | E85L | + |
| 51/52 | L243A | + |
| 53/54 | Q237E | + |
| 55/56 | L120F | + |
| 57/58 | V343N | + |
| 59/60 | A324D | + |
| 61/62 | P200V | + |
| 63/64 | G95R | + |
| 65/66 | R326K | + |
| 67/68 | P28A | + |
| 69/70 | W327Q | + |
| 71/72 | V343P | + |
| 73/74 | V250Q | + |
| 75/76 | S65A | + |
| 77/78 | R281S | + |
| 79/80 | A185D | + |
| 81/82 | R326H | + |
| 83/84 | M289D | + |
| 85/86 | R326G | + |
| 87/88 | R21Q | + |
| 89/90 | R268H | + |
| 91/92 | A346S | + |
| 93/94 | V307I | + |

[1] Levels of increased selectivity were determined relative to the reference polypeptide of SEQ ID NO: 4 and defined as follows: "+" 1.00 to 2.00, "++" > 2.00, "+++" > 3.00

TABLE 4.2

Activity of Variants Relative to SEQ ID NO: 4

| SEQ ID NO: (nt/aa) | Amino Acid Differences (Relative to SEQ ID NO: 4) | FIOP [1] (Activity ratio) (Relative to SEQ ID NO: 4) |
|---|---|---|
| 95/96 | M139F | +++ |
| 97/98 | S335M | +++ |
| 99/100 | S335A | ++ |
| 87/88 | R21Q | ++ |
| 63/64 | G95R | ++ |
| 91/92 | A346S | ++ |
| 75/76 | S65A | + |
| 101/102 | L243V | + |
| 83/84 | M289D | + |
| 103/104 | R281T | + |
| 57/58 | V343N | + |
| 79/80 | A185D | + |
| 69/70 | W327Q | + |
| 77/78 | R281S | + |
| 59/60 | A324D | + |
| 67/68 | P28A | + |
| 105/106 | S177P | + |
| 81/82 | R326H | + |
| 35/36 | L282E | + |
| 43/44 | L282S | + |
| 21/22 | D287E | + |
| 37/38 | T199A | + |
| 73/74 | V250Q | + |
| 85/86 | R326G | + |
| 93/94 | V307I | + |
| 107/108 | R112L | + |
| 65/66 | R326K | + |
| 109/110 | V250T | + |
| 111/112 | T199A | + |
| 33/34 | M338I | + |
| 47/48 | A117S | + |
| 19/20 | V233A | + |
| 113/114 | Y45S | + |
| 71/72 | V343P | + |

[1] Levels of increased activity were determined relative to the reference polypeptide of SEQ ID NO: 4 and defined as follows: "+" 1.00 to 2.00, "++" > 2.00, "+++" > 3.00

In addition to the HTP analysis, a select subset of beneficial variants from the HTP screening was also prepared in shake flask scale as described in Example 3 (with protein expression overnight at 20° C.). Lyophilized shake flask lysate powders (SFP) were tested in 1 mL scale reactions under the following conditions: 10 g/L L-proline, 50 wt % proline hydroxylase variant SFP, 1.5 equiv. a-KG (α-ketoglutaric acid), 0.15 equiv. ascorbic acid, 4 mM ammonium iron(II) sulfate hexahydrate, 50 mM sodium phosphate pH 6.5, air, and room temperature. Reactions were run overnight and analyzed using similar methods described above for the HTP reactions. Selectivity relative to SEQ ID NO: 4 (Selectivity FIOP) was calculated as the ratio of trans-3-hydroxyproline: trans-4-hydroxyproline of the product formed by the variant over the ratio produced by SEQ ID NO: 4. The results are shown in Table 4.3.

TABLE 4.3

Selectivity of Variants Relative to SEQ ID NO: 4

| SEQ ID NO: (nt/aa) | Amino Acid Differences (Relative to SEQ ID NO: 4) | FIOP [1] (Selectivity ratio) (Relative to SEQ ID NO: 4) |
|---|---|---|
| 115/116 | A48V;Y66W;A189N;N194L | + |
| 117/118 | A48V;Y66W;N194L | ++ |
| 119/120 | Y66W;K82P;E85P;A135P;A189N;N194L;G267D | + |

1 Levels of increased selectivity were determined relative to the reference polypeptide of SEQ ID NO: 4 and defined as follows: "+" 2.00 to 3.00, "++" > 3.00

The proline hydroxylase protein produced by SEQ ID NO: 4 was not fully stable under standard expression conditions at 30° C. As described above, HTP and shake flask proteins were produced with expression at 20° C. for all data shown in Tables 4.1, 4.2, and 4.3. In order to select for more stable and active variants, libraries of engineered genes derived from SEQ ID NO: 4 were produced using well-established techniques (e.g., saturation mutagenesis, and recombination of previously identified beneficial mutations), and the polypeptides encoded by each gene were produced in HTP with expression at 30° C. Reactions, derivatization, and analysis were performed as described above. Stability and activity relative to SEQ ID NO:4 (Stability/Activity FIOP) was calculated as the ratio of the peak area of trans-3-hydroxyproline of the variant compared with the peak area of trans-3-hydroxyproline: produced by SEQ ID NO: 4 where both enzymes were produced at 30° C. The results are shown in Table 4.4.

TABLE 4.4

Stability/Activity of Variants Relative to SEQ ID NO: 4

| SEQ ID NO: (nt/aa) | Amino Acid Differences (Relative to SEQ ID NO: 4) | FIOP [1] (Stability/Activity ratio) (Relative to SEQ ID NO: 4) |
|---|---|---|
| 121/122 | Y147F | +++ |
| 123/124 | H76E;H294Y;L296I | ++ |

TABLE 4.4-continued

Stability/Activity of Variants Relative to SEQ ID NO: 4

| SEQ ID NO: (nt/aa) | Amino Acid Differences (Relative to SEQ ID NO: 4) | FIOP [1] (Stability/Activity ratio) (Relative to SEQ ID NO: 4) |
|---|---|---|
| 125/126 | H76E;L296I | ++ |
| 127/128 | S56P;H76E;H294Y | ++ |
| 129/130 | Y20F;S56P;Q232E;H294Y | + |
| 131/132 | S56P;H76E;E119D;W124F;Y147F;Q232E | + |
| 133/134 | Y20F;S56P;H76E;C 168A;1169L;L296I | + |
| 135/136 | Y20F;El 19D;H294Y;L296I | + |
| 137/138 | H76E;C168A;Q232E;H294Y | + |
| 139/140 | Q232E | + |

[1] Levels of increased stability/activity were determined relative to t re reference polypeptide of SEQ ID NO: 4 and defined as follows: "+" 1.20 to 1.50, "++" > 1.50, "+++" >2.10

Example 5

Improvements Over SEQ ID NO: 116 in the Conversion of Proline Substrate to Trans-3-Hydroxyproline Libraries of engineered genes were produced from the engineered polynucleotide (SEQ ID NO: 115) encoding the polypeptide with proline hydroxylase activity of SEQ ID NO: 116 using well-established techniques (e.g., saturation mutagenesis, and recombination of previously identified beneficial mutations). The polypeptides encoded by each gene were produced in HTP as described in Example 2 (with protein expression overnight at 20° C.). For all variants, the cell pellets were lysed by adding 200 μL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 μL round bottom plate, 50 μL of the *E. coli* lysates were added to 200 μL of reaction mix (comprising 75 μL of 63 g/L α-ketoglutaric acid [in 50 mM sodium phosphate pH 6.5], 50 μL of 20 mM Mohr's salt in 65 mM ascorbic acid [in 50 mM sodium phosphate pH 6.5], and 75 μL of 33 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 μL of the reaction mix into a 96-well deep-well plate containing 225 μL derivatization solution (comprising 75 μL of saturated sodium bicarbonate, 25 μL water, and 125 μL of 2.5 mg/mL FmocCl [in ACN] per well). After 1 hr of shaking at room temperature, the plate was centrifuged for one minute at 4000 rpm, and 40 μL of the soluble fraction of the quenched reaction were mixed with 160 μL of 1:1 ACN: 0.5M HCl. The derivatized and diluted samples were analyzed as described in Table 13.1. Selectivity relative to SEQ ID NO: 116 (Selectivity FIOP) was calculated as the ratio of trans-3-hydroxyproline: trans-4-hydroxyproline of the product formed by the variant over the ratio produced by SEQ ID NO: 116. The results are shown in Table 5.1.

TABLE 5.1

Selectivity of Variants Relative to SEQ ID NO: 116

| SEQ ID NO: (nt/aa) | Amino Acid Differences (Relative to SEQ ID NO: 116) | FIOP [1] (Selectivity ratio) (Relative to SEQ ID NO: 116) |
|---|---|---|
| 141/142 | S123T | +++ |
| 143/144 | N189S | ++ |
| 145/146 | N189A | ++ |
| 147/148 | V233A | + |
| 149/150 | L296V | + |
| 151/152 | V233M | + |
| 153/154 | H195Y | + |

[1] Levels of increased selectivity were determined relative to the reference polypeptide of SEQ ID NO: 116 and defined as follows: "+" 1.00 to 1.15, "++" > 1.15, "+++" > 1.5

The proline hydroxylase protein produced by SEQ ID NO: 116 was not fully stable under standard expression condition at 30° C. In order to select for more stable and active variants, libraries of engineered genes derived from SEQ ID NO: 116 were produced using well-established techniques (e.g., saturation mutagenesis, and recombination of previously identified beneficial mutations), and the polypeptides encoded by each gene were produced in HTP with expression at 30° C. Reactions, derivatization, and analysis were done as described above. Stability and activity relative to SEQ ID NO: 116 (Stability/Activity FIOP) was calculated as the ratio of the peak area of trans-3-hydroxyproline of the variant compared with the peak area of trans-3-hydroxyproline: produced by SEQ ID NO: 116, where both enzymes were produced at 30° C. The results are shown in Table 5.2.

TABLE 5.2

Stability/Activity of Variants Relative to SEQ ID NO: 116

| SEQ ID NO: (nt/aa) | Amino Acid Differences (Relative to SEQ ID NO: 116) | FIOP [1] (Stability/Activity ratio) (Relative to SEQ ID NO: 116) |
|---|---|---|
| 155/156 | Y20F;R21Q;S56P;H76E;G95R;Q232E;H294YV307I;S335M | +++ |
| 157/158 | R21Q;G95R;H294Y;L296I;V307I;S335M | +++ |
| 159/160 | G95R;Y147F;S335M | +++ |
| 161/162 | R21Q;H76E;Y147F;L243V;L296I;V307I;S335M | +++ |
| 163/164 | Y20F;R21Q;S56P;G95R;Y147F;R281T;H294Y;V307I | +++ |
| 165/166 | G95R;R281T;H294Y;L296I | ++ |
| 167/168 | S56P;G95P;Y147F;V307I;S335M;Q348K | ++ |

TABLE 5.2-continued

Stability/Activity of Variants Relative to SEQ ID NO: 116

| SEQ ID NO: (nt/aa) | Amino Acid Differences (Relative to SEQ ID NO: 116) | FIOP [1] (Stability/Activity ratio) (Relative to SEQ ID NO: 116) |
|---|---|---|
| 169/170 | H76E;Y147F;L243V;H294Y;L296I;V307L;S335M | ++ |
| 171/172 | Y20F;R21 Q;G95R;R281T;H294Y;L296I | ++ |
| 173/174 | Y20F;S56P;H76E;Y147F;H294Y;L296I;V307L | ++ |
| 175/176 | Y20F;H76E;G95R;R281T;L296I;V307I | ++ |
| 177/178 | Y20F;H76E;G95R;R281 S;H294Y;L296I | ++ |
| 179/180 | G95R;Q232E;L243V;R281T;H294Y;V307I | ++ |
| 181/182 | S56P;H76E;Y147F;R281T;V307I | ++ |
| 183/184 | V233A;L243V;R281S;L296I;V307I;S335M | ++ |
| 185/186 | H76E;G95R;H294Y;V307L | ++ |
| 187/188 | Q232E;V233A;R281T;H294Y;L296I;V307I | ++ |
| 189/190 | H76E;G95R;L243V;R281S;V307I;S335M | ++ |
| 191/192 | Y147F;V307I | ++ |
| 193/194 | S56P;Q232E;R281 S;H294Y;L296I | ++ |
| 195/196 | Y20F;H76E;V233A;H294Y;V307I | ++ |
| 197/198 | H76E;Y147F;V233A;L243V;H294Y | ++ |
| 199/200 | H76E;Y147F;V233R;R281T;H294Y;V307L | ++ |
| 201/202 | L243V;R281 S;H294Y;L296I | ++ |
| 203/204 | H76E;Y147F;R281S;V307L | ++ |
| 205/206 | H76E;H294Y;L296I | ++ |
| 207/208 | H76E;Q232E;V233R;L243V;H294Y;L296I;V307I | ++ |
| 209/210 | R21Q;G95R;A185L;N189A;Q232E;R281T;L296I | + |
| 211/212 | H76E;R281T;H294Y | + |
| 213/214 | R21Q;H76E;Y147F;V233R;H294Y;V307I | + |
| 215/216 | S56P;H76E;L243V;H294Y | + |
| 217/218 | S56P;H76E;R281T;H294Y | + |
| 219/220 | Y147F;V233R;R281T;V307L;S335M | + |
| 221/222 | Y20F;H76E;L243V;R281T;H294Y | + |
| 223/224 | Y20F;S56P;G95P;Y147F;H294Y | + |
| 225/226 | R281T;H294Y | + |
| 227/228 | Y147F | + |
| 229/230 | H76E;N189A;L296I | + |
| 231/232 | Y147F;L243V;R281S | + |
| 233/234 | G95R;S335M | + |
| 235/236 | S56P;Y147F;R281T | + |
| 237/238 | H76E;Y147F | + |
| 239/240 | S56P;H76E;L296I | + |
| 241/242 | G95P;Q232E;R281T;H294Y;L296I | + |
| 243/244 | Y147F;V233A;L243V;R281S;V307L | + |
| 245/246 | S56P;H76E;G95R;Q232E;L243V;R28 IT | + |
| 247/248 | Y20F;R21Q;G95R;Q232E;V307I | + |
| 249/250 | Y20F;S56P;H76E;G95R;R281S;V307I | + |
| 251/252 | Y20F;R21Q;S56P;H76E;Y147F;Q225R;Q232E; V233A;R281S;H294Y;L296I;V307L;S335M | + |
| 253/254 | V233A;R28 1T;L296I;V3O7I | + |
| 255/256 | S56P;V233R;R281S;H294Y;L296I | + |
| 257/258 | S335M | + |
| 259/260 | Y20F;R21Q;Y147F;N189A;V233R;L243V;R281T; V307I | + |
| 261/262 | S56P;G95R;Q232E;V233R;R281S;H294Y;V307L | + |
| 263/264 | R21Q;G95R;V233A;L243V;R281T;L296I | + |
| 265/266 | S56P;H76E;V307I | + |
| 267/268 | S56P;Q232E;R281S | + |
| 269/270 | Y20F;R21Q;S56P;R281T;V307L | + |
| 271/272 | S56P;Q232E;L243V;R281S | + |
| 273/274 | H76E;G95P;Q232E;L243V;R281 S;V307L | + |
| 275/276 | R21Q;G95R;V307I | + |
| 277/278 | Y20F;R21Q;H76E;Q232E;L243V | + |
| 279/280 | R21Q;R281T;V307L | + |
| 281/282 | R281T;V307L | + |
| 283/284 | S56P;R281T;V307I | + |
| 285/286 | Y20F;S56P | + |
| 287/288 | Q232E;R281T | + |
| 289/290 | Y20F;S56P;R281S | + |
| 291/292 | R281T;V307I | + |
| 293/294 | H76E;R281S | + |
| 295/296 | Q232E;G284R;V307I | + |
| 297/298 | G95R;L120P | + |
| 299/300 | Y20F;H76E | + |
| 301/302 | Y147F;Q225R;Q232E;L243V;R281S;L296I;V307L; S335M | + |
| 303/304 | S56P;G95R;L243V;R28 IT | + |
| 305/306 | G95P;S335M | + |
| 307/308 | V307I | + |
| 309/310 | A29T;H76E;R281T | + |

TABLE 5.2-continued

Stability/Activity of Variants Relative to SEQ ID NO: 116

| SEQ ID NO: (nt/aa) | Amino Acid Differences (Relative to SEQ ID NO: 116) | FIOP [1] (Stability/Activity ratio) (Relative to SEQ ID NO: 116) |
|---|---|---|
| 311/312 | Y20F;R21Q;S56P | + |
| 313/314 | R281T | + |

[1] Levels of increased stability/activity were determined relative to the reference polypeptide of SEQ ID NO: 116 and defined as follows: "+" 1.00 to 30.00, "++" > 30.00, "+++" > 70.00

In addition to the HTP analysis, a select subset of beneficial variants from the HTP screening was also prepared in shake flask scale as described in Example 3. SFP for SEQ ID NO: 116 was produced at 20° C., and the variants derived from SEQ ID NO: 116 were produced at 30° C. Lyophilized shake flask lysate powders (SFP) were tested in 1 mL scale reactions under the following conditions: 20 g/L L-proline, 5 wt % proline hydroxylase variant SFP, 1.5 equiv. a-KG (α-ketoglutaric acid), 0.15 equiv. ascorbic acid, 4 mM ammonium iron(II) sulfate hexahydrate, 50 mM sodium phosphate pH 6.5, air, and room temperature. Reactions were run overnight and analyzed using similar methods described above for the HTP reactions. Stability and activity relative to SEQ ID NO: 116 (Stability/Activity FIOP) was calculated as the ratio of the peak area of trans-3-hydroxyproline of the variant compared with the peak area of trans-3-hydroxyproline produced by SEQ ID NO: 116, where SEQ ID NO: 116 was produced at 20° C., and the variants derived from SEQ ID NO: 116 were produced at 30° C. The results are shown in Table 5.3.

TABLE 5.3

Stability/Activity of Variants Relative to SEQ ID NO: 116

| SEQ ID NO: (nt/aa) | Amino Acid Differences (Relative to SEQ ID NO: 116) | FIOP[1] (Stability/ Activity ratio) (Relative to SEQ ID NO: 116) |
|---|---|---|
| 161/162 | R21Q; H76E; Y147F; L243V; L296I; V307I; S335M | + |
| 159/160 | G95R; Y147F; S335M | + |
| 181/182 | S56P; H76E; Y147F; R281T; V307I | + |

[1]Levels of increased stability/activity were determined relative to the reference polypeptide of SEQ ID NO: 116 and defined as follows: "+" from 3.0 to 3.5

Example 6

Improvements Over SEQ ID NO: 162 in the Conversion of Proline Substrate to Trans-3-Hydroxyproline Libraries of engineered genes were produced from the engineered polynucleotide (SEQ ID NO: 161) encoding the polypeptide with proline hydroxylase activity of SEQ ID NO: 162 using well-established techniques (e.g., saturation mutagenesis, and recombination of previously identified beneficial mutations). The polypeptides encoded by each gene were produced in HTP as described in Example 2 (with protein expression overnight at 30° C.). For all variants, the cell pellets were lysed by adding 400 μL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 μL round bottom plate, 50 μL of the E. coli lysates were added to 200 μL of reaction mix (comprising 75 μL of 133 g/L α-ketoglutaric acid [in 50 mM sodium phosphate pH 6.5], 50 μL of 20 mM Mohr's salt in 65 mM ascorbic acid [in 50 mM sodium phosphate pH 6.5], and 75 μL of 67 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 μL of the reaction mix into a 96-well deep-well plate containing 225 μL derivatization solution (comprising 75 μL of saturated sodium bicarbonate, 25 μL water, and 125 μL of 2.5 mg/mL FmocCl [in ACN] per well). After 1 hr of shaking at room temperature, the plate was centrifuged for one minute at 4000 rpm, and 40 μL of the soluble fraction of the quenched reaction were mixed with 160 μL of 1:1 ACN: 0.5M HCl. The derivatized and diluted samples were analyzed as described in Table 13.1. Selectivity relative to SEQ ID NO: 162 (Selectivity FIOP) was calculated as the ratio of trans-3-hydroxyproline: trans-4-hydroxyproline of the product formed by the variant over the ratio produced by SEQ ID NO: 162.

In addition to the HTP analysis, a select subset of beneficial variants from the HTP screening was also prepared in shake flask scale as described in Example 3 with expression at 30° C. Lyophilized shake flask lysate powders (SFP) were tested in 1 mL scale reactions under the following conditions: 40 g/L L-proline, 5 wt % proline hydroxylase variant SFP, 1.2 equiv. a-KG (α-ketoglutaric acid), 25 mM ascorbic acid, 4 mM ammonium iron (II) sulfate hexahydrate, 50 mM sodium phosphate pH 6.5, air, and room temperature. Reactions were run overnight and analyzed using similar methods described above for the HTP reactions. Selectivity relative to SEQ ID NO: 162 (Selectivity FIOP) was calculated as the ratio of trans-3-hydroxyproline: trans-4-hydroxyproline of the product formed by the variant over the ratio produced by SEQ ID NO: 162. The results are shown in Table 6.1.

TABLE 6.1

Selectivity of Variants Relative to SEQ ID NO: 162

| SEQ ID NO: (nt/aa) | Amino Acid Differences (Relative to SEQ ID NO: 162) | FIOP[1] (Selectivity ratio) (Relative to SEQ ID NO: 162) |
|---|---|---|
| 315/316 | Y45S; S123T; R326G | + |
| 317/318 | E85L; S123T; R281T; L282S | + |
| 319/320 | G2L; E85L; S123T; Q237E | ++ |
| 321/322 | S123T; M139F; V233A; Q237E; R281M; L282S; M289D; A324Q; R326G | +++ |
| 323/324 | S123T; T199A; P200V; P247L; V250Q; M338I | + |
| 325/326 | S65R; A117V; L120I; S123T; V343N; A346G | ++ |

TABLE 6.1-continued

Selectivity of Variants Relative to SEQ ID NO: 162

| SEQ ID NO: (nt/aa) | Amino Acid Differences (Relative to SEQ ID NO: 162) | FIOP[1] (Selectivity ratio) (Relative to SEQ ID NO: 162) |
|---|---|---|
| 327/328 | E114G; V115T; A117T; L120P; S123T; R268T; S271A; L313F; R326G; V343N; A346S | + |
| 329/330 | P28A; V115T; A117V; L120I; S123T; R268T; R270L; V343N; A346S; Q348S | ++ |

[1]Levels of increased selectivity were determined relative to the reference polypeptide of SEQ ID NO: 162 and defined as follows: "+" 1.45 to 1.60, "++" >1.60, "+++" >1.75

Example 7

Improvements Over SEQ ID NO: 322 in the Conversion of Proline Substrate to Trans-3-Hydroxyproline Libraries of engineered genes were produced from the engineered polynucleotide (SEQ ID NO: 321) encoding the polypeptide with proline hydroxylase activity of SEQ ID NO: 322 using well-established techniques (e.g., saturation mutagenesis, and recombination of previously identified beneficial mutations). The polypeptides encoded by each gene were produced in HTP as described in Example 2 (with protein expression overnight at 30° C.). For all variants, the cell pellets were lysed by adding 400 µL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 µL round bottom plate, 50 µL of the E. coli lysates were added to 200 µL of reaction mix (comprising 75 µL of 266 g/L α-ketoglutaric acid [in 50 mM sodium phosphate pH 6.5], 50 µL of 20 mM Mohr's salt in 65 mM ascorbic acid [in 50 mM sodium phosphate pH 6.5], and 75 µL of 133 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 µL of the reaction mix into a 96-well deep-well plate containing 225 µL derivatization solution (comprising 75 µL of saturated sodium bicarbonate, 25 µL water, and 125 µL of 2.5 mg/mL FmocCl [in ACN] per well). After 1 hr of shaking at room temperature, the plate was centrifuged for one minute at 4000 rpm, and 40 µL of the soluble fraction of the quenched reaction were mixed with 160 µL of 1:1 ACN: 0.5M HCl. The derivatized and diluted samples were analyzed as described in Table 13.1. Selectivity relative to SEQ ID NO: 322 (Selectivity FIOP) was calculated as the ratio of trans-3-hydroxyproline: trans-4-hydroxyproline of the product formed by the variant over the ratio produced by SEQ ID NO: 322. Activity relative to SEQ ID NO: 322 (Activity FIOP) was calculated as the ratio of the peak area of trans-3-hydroxyproline of the variant compared with the peak area of trans-3-hydroxyproline: produced by SEQ ID NO: 322. The results are shown in Tables 7.1 and 7.2 respectively.

TABLE 7.1

Selectivity of Variants Relative to SEQ ID NO: 322

| SEQ ID NO: (nt/aa) | Amino Acid Differences (Relative to SEQ ID NO: 322) | FIOP[1] (Selectivity ratio) (Relative to SEQ ID NO: 322) |
|---|---|---|
| 331/332 | N189S | +++ |
| 333/334 | V228T | +++ |
| 335/336 | S262V | ++ |
| 337/338 | V277A | ++ |
| 339/340 | G26N | ++ |
| 341/342 | D61H | + |
| 343/344 | A201C | + |
| 345/346 | A201T | + |
| 347/348 | L175S | + |
| 349/350 | Q236T | + |
| 351/352 | L175V | + |
| 353/354 | E132P | + |
| 355/356 | A129I | + |
| 357/358 | V272S | + |
| 359/360 | V156S | + |
| 361/362 | T345R | + |
| 363/364 | A201G | + |
| 365/366 | P291G | + |
| 367/368 | G54P | + |
| 369/370 | D248R | + |
| 371/372 | S149G | + |
| 373/374 | C209S | + |

[1]Levels of increased selectivity were determined relative to the reference polypeptide of SEQ ID NO: 322 and defined as follows: "+" 1.00 to 1.20, "++" >1.20, "+++" >1.30

TABLE 7.2

Activity of Variants Relative to SEQ ID NO: 322

| SEQ ID NO: (nt/aa) | Amino Acid Differences (Relative to SEQ ID NO: 322) | FIOP[1] (Activity ratio) (Relative to SEQ ID NO: 322) |
|---|---|---|
| 375/376 | S278N | +++ |
| 377/378 | A347E | ++ |
| 379/380 | A129I | ++ |
| 381/382 | C209S | ++ |
| 367/368 | G54P | ++ |
| 383/384 | Q163L | ++ |
| 361/362 | T345R | ++ |
| 385/386 | A43T | + |
| 387/388 | E58T | + |
| 389/390 | D143L | + |
| 391/392 | H25K | + |
| 393/394 | V156D | + |
| 351/352 | L175V | + |
| 365/366 | P291G | + |
| 341/342 | D61H | + |
| 395/396 | Q79T | + |
| 369/370 | D248R | + |
| 397/398 | E132N | + |
| 399/400 | G54S | + |
| 349/350 | Q236T | + |
| 359/360 | V156S | + |
| 401/402 | E179L | + |
| 343/344 | A201C | + |

[1]Levels of increased activity were determined relative to the reference polypeptide of SEQ ID NO: 322 and defined as follows: "+" 1.00 to 1.30, "++" >1.30, "+++" >1.90

In addition to the HTP analysis, a select subset of beneficial variants from the HTP screening was also prepared in shake flask scale as described in Example 3 with expression at 30° C. Lyophilized shake flask lysate powders (SFP) were tested in 1 mL scale reactions under the following conditions: 40 g/L L-proline, 5 wt % proline hydroxylase variant SFP, 1.2 equiv. a-KG (α-ketoglutaric acid), 10 mM ascorbic acid, 4 mM ammonium iron (II) sulfate hexahydrate, 50 mM sodium phosphate pH 6.5, air, and room temperature. Reactions were run overnight and analyzed using similar methods described above for the HTP reactions. Selectivity relative to SEQ ID NO: 322 (Selectivity FIOP) was calculated as the ratio of trans-3-hydroxyproline: trans-4-hydroxyproline of the product formed by the variant over the ratio produced by SEQ ID NO: 322. The results are shown in Table 7.3.

TABLE 7.3

Selectivity of Variants Relative to SEQ ID NO: 322

| SEQ ID NO: (nt/aa) | Amino Acid Differences (Relative to SEQ ID NO: 322) | FIOP[1] (Selectivity ratio) (Relative to SEQ ID NO: 322) |
|---|---|---|
| 403/404 | E85L; A117V; L120I; A135S; A208E; R270L; Q324A; V343N; A346G | + |
| 405/406 | E85L; A117T; A135S; F139M; A208E | + |
| 407/408 | A117T; L120I; A208E; R270L; Q324A; V343N; A346G | + |
| 409/410 | E85L; A117V; L120P; R270L; M281R; D289M | + |
| 411/412 | E85L; A117T; L120P; A135S; A208E; M281R; S282L; D289M | + |

[1]Levels of increased selectivity were determined relative to the reference polypeptide of SEQ ID NO: 322 and defined as follows: "+" from 1.00 to 1.15

Example 8

Improvements Over SEQ ID NO: 412 in the Conversion of Proline Substrate to Trans-3-Hydroxyproline Libraries of engineered genes were produced from the engineered polynucleotide (SEQ ID NO: 411) encoding the polypeptide with proline hydroxylase activity of SEQ ID NO: 412 using well-established techniques (e.g., saturation mutagenesis, and recombination of previously identified beneficial mutations). The polypeptides encoded by each gene were produced in HTP as described in Example 2 (with protein expression overnight at 30° C.). For all variants, the cell pellets were lysed by adding 400 μL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 μL round bottom plate, 50 μL of the E. coli lysates were added to 200 μL of reaction mix (comprising 75 μL of 266 g/L α-ketoglutaric acid [in 50 mM sodium phosphate pH 6.5], 50 μL of 20 mM Mohr's salt in 65 mM ascorbic acid [in 50 mM sodium phosphate pH 6.5], and 75 μL of 133 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 μL of the reaction mix into a 96-well deep-well plate containing 225 μL derivatization solution (comprising 75 μL of saturated sodium bicarbonate, 25 μL water, and 125 μL of 2.5 mg/mL FmocCl [in ACN] per well). After 1 hr of shaking at room temperature, the plate was centrifuged for one minute at 4000 rpm, and 40 μL of the soluble fraction of the quenched reaction were mixed with 160 μL of 1:1 ACN: 0.5M HCl. The derivatized and diluted samples were analyzed as described in Table 13.1. Selectivity relative to SEQ ID NO: 412 (Selectivity FIOP) was calculated as the ratio of trans-3-hydroxyproline: trans-4-hydroxyproline of the product formed by the variant over the ratio produced by SEQ ID NO: 412. The results are shown in Table 8.1.

TABLE 8.1

Selectivity of Variants Relative to SEQ ID NO: 412

| SEQ ID NO: (nt/aa) | Amino Acid Differences (Relative to SEQ ID NO: 412) | FIOP[1] (Selectivity ratio) (Relative to SEQ ID NO: 412) |
|---|---|---|
| 413/414 | H162L | +++ |
| 415/416 | H162 V | +++ |
| 417/418 | H162V; L204S | ++ |
| 419/420 | H162M | ++ |
| 421/422 | H162A | ++ |
| 423/424 | S164D; A198V; S271V | ++ |
| 425/426 | I169T | ++ |
| 427/428 | S271V | ++ |
| 429/430 | S113P | ++ |
| 431/432 | I169C | ++ |
| 433/434 | V243Y | ++ |
| 435/436 | H195Y | ++ |
| 437/438 | V48G | + |
| 439/440 | I169V | + |
| 441/442 | F47M | + |
| 443/444 | S113R | + |
| 445/446 | R275K | + |
| 447/448 | G95W | + |
| 449/450 | L330G | + |
| 451/452 | C187P | + |
| 453/454 | F314S | + |
| 455/456 | S56P; A118W | + |
| 457/458 | F154L | + |
| 459/460 | F314A | + |
| 461/462 | S164T | + |
| 463/464 | A118W | + |
| 465/466 | S113N | + |
| 467/468 | A118V | + |
| 469/470 | S113H | + |
| 471/472 | N342R | + |
| 471/472 | N342R | + |
| 473/474 | A118D | + |
| 475/476 | C168V | + |
| 477/478 | F314T | + |
| 479/480 | A118P; P247A | + |
| 481/482 | G95A; M289V | + |
| 483/484 | L330H | + |
| 485/486 | L85P | + |
| 487/488 | R281L | + |

[1]Levels of increased selectivity were determined relative to the reference polypeptide of SEQ ID NO: 412 and defined as follows: "+" 1.00 to 1.10, "++" 1.10 to 1.20, "+++" 1.30

In addition to the HTP analysis, a select subset of beneficial variants from the HTP screening was also prepared in shake flask scale as described in Example 3 with expression at 30° C. Lyophilized shake flask lysate powders (SFP) were tested in 1 mL scale reactions under the following conditions: 60 g/L L-proline, 5 wt % proline hydroxylase variant SFP, 1.2 equiv. a-KG (α-ketoglutaric acid), 10 mM ascorbic acid, 4 mM ammonium iron (II) sulfate hexahydrate, 50 mM sodium phosphate pH 6.8, air, and room temperature. Reactions were run overnight and analyzed using similar methods described above for the HTP reactions. Selectivity relative to SEQ ID NO: 412 (Selectivity FIOP) was calculated as the ratio of trans-3-hydroxyproline: trans-4-hydroxyproline of the product formed by the variant over the ratio produced by SEQ ID NO: 412. The results are shown in Table 8.2.

TABLE 8.2

Selectivity of Variants Relative to SEQ ID NO: 412

| SEQ ID NO: (nt/aa) | Amino Acid Differences (Relative to SEQ ID NO: 412) | FIOP[1] (Selectivity ratio) (Relative to SEQ ID NO: 412) |
|---|---|---|
| 489/490 | H25K; A129I; Q163L; Q236T; S262V; T345R; A347E | ++ |
| 491/492 | A129I; N189S; Q236T; S262V; V277A; S278N | +++ |
| 493/494 | A129I; Q236T; S262V | ++ |
| 495/496 | P120V; V156S; L175V; E179L; A201G | + |
| 497/498 | V156S; L175V; E179L; V228A | + |
| 499/500 | H162V | + |
| 413/414 | H162L | + |

[1] Levels of increased selectivity were determined relative to the reference polypeptide of SEQ ID NO: 412 and defined as follows: "+" 1.10 to 1.40, "++" >1.40, "+++" >1.80

Example 9

Improvements Over SEQ ID NO: 492 in the Conversion of Proline Substrate to Trans-3-Hydroxyproline Libraries of engineered genes were produced from the engineered polynucleotide (SEQ ID NO: 491) encoding the polypeptide with proline hydroxylase activity of SEQ ID NO: 492 using well-established techniques (e.g., saturation mutagenesis, and recombination of previously identified beneficial mutations). The polypeptides encoded by each gene were produced in HTP as described in Example 2 (with protein expression overnight at 30° C.). For all variants, the cell pellets were lysed by adding 600 µL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 µL round bottom plate, 50 µL of the *E. coli* lysates were added to 200 µL of reaction mix (comprising 75 µL of 667 g/L α-ketoglutaric acid [in 50 mM sodium phosphate pH 6.5], 50 µL of 20 mM Mohr's salt in 65 mM ascorbic acid [in 50 mM sodium phosphate pH 6.5], and 75 µL of 333 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 µL of the reaction mix into a 96-well deep-well plate containing 225 µL derivatization solution (comprising 75 µL of saturated sodium bicarbonate, 25 µL water, and 125 µL of 2.5 mg/mL FmocCl [in ACN] per well). After 1 hr of shaking at room temperature, the plate was centrifuged for one minute at 4000 rpm, and 40 µL of the soluble fraction of the quenched reaction were mixed with 160 µL of 1:1 ACN: 0.5M HCl. The derivatized and diluted samples were analyzed as described in Table 13.1. Selectivity relative to SEQ ID NO: 492 (Selectivity FIOP) was calculated as the ratio of trans-3-hydroxyproline: trans-4-hydroxyproline of the product formed by the variant over the ratio produced by SEQ ID NO: 492. The results are shown in Table 9.1.

TABLE 9.1

Selectivity of Variants Relative to SEQ ID NO: 492

| SEQ ID NO: (nt/aa) | Amino Acid Differences (Relative to SEQ ID NO: 492) | FIOP[1] (Selectivity ratio) (Relative to SEQ ID NO: 492) |
|---|---|---|
| 501/502 | V228T | ++ |
| 503/504 | H294T | + |
| 505/506 | E208L | + |
| 507/508 | S17C | + |
| 509/510 | S135T | + |
| 511/512 | E208S | + |
| 513/514 | Q167G | + |
| 515/516 | D235E | + |
| 517/518 | A29S | + |
| 519/520 | S177A | + |
| 521/522 | S177P | + |
| 523/524 | S177L | + |
| 525/526 | I307L | + |
| 527/528 | I15V | + |
| 529/530 | S65V | + |
| 531/532 | P28I | + |
| 533/534 | D287E | + |
| 535/536 | S135G | + |
| 537/538 | S135N | + |
| 539/540 | T199C | + |
| 541/542 | E208M | + |
| 543/544 | V343S | + |
| 545/546 | V343T | + |

[1] Levels of increased selectivity were determined relative to the reference polypeptide of SEQ ID NO: 492 and defined as follows: "+" 1.00 to 1.10, "++" >1.10

In addition to the HTP analysis, a select subset of beneficial variants from the HTP screening was also prepared in shake flask scale as described in Example 3 with expression at 30° C. Lyophilized shake flask lysate powders (SFP) were tested in 1 mL scale reactions under the following conditions: 60 g/L L-proline, 5 wt % proline hydroxylase variant SFP, 1.2 equiv. a-KG (α-ketoglutaric acid), 10 mM ascorbic acid, 4 mM ammonium iron (II) sulfate hexahydrate, 50 mM sodium phosphate pH 6.8, air, and room temperature. Reactions were run overnight and analyzed using similar methods described above for the HTP reactions. Selectivity relative to SEQ ID NO: 492 (Selectivity FIOP) was calculated as the ratio of trans-3-hydroxyproline: trans-4-hydroxyproline of the product formed by the variant over the ratio produced by SEQ ID NO: 492. The results are shown in Table 9.2.

TABLE 9.2

Selectivity of Variants Relative to SEQ ID NO: 492

| SEQ ID NO: (nt/aa) | Amino Acid Differences (Relative to SEQ ID NO: 492) | FIOP[1] (Selectivity ratio) (Relative to SEQ ID NO: 492) |
|---|---|---|
| 547/548 | L85P; C187P; R281L; A347E | + |
| 549/550 | L85P; C187P; A347E | + |
| 551/552 | H195Y; A347E | + |
| 553/554 | N278S; F314A; A347E | + |
| 555/556 | A118V; P120V; H162V; L175V; L330H | + |
| 557/558 | L175V; V228A; L330H | + |
| 559/560 | A118V; P120V; H162V; L175V; E179L; L330H | ++ |
| 561/562 | H162V; L175V; E179L; L330H | + |

[1] Levels of increased selectivity were determined relative to the reference polypeptide of SEQ ID NO: 492 and defined as follows: "+" 1.00 to 1.20, "++" >1.20

Example 10

Improvements Over SEQ ID NO: 562 in the Conversion of Proline Substrate to Trans-3-Hydroxyproline Libraries of engineered genes were produced from the engineered polynucleotide (SEQ ID NO: 561) encoding the polypeptide with proline hydroxylase activity of SEQ ID NO: 562 using well-established techniques (e.g., saturation mutagenesis, and recombination of previously identified beneficial mutations). The polypeptides encoded by each gene were produced in HTP as described in Example 2 (with protein expression overnight at 30° C.). For all variants, the cell pellets were lysed by adding 400 µL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 µL round bottom plate, 50 µL of the E. coli lysates were added to 200 µL of reaction mix (comprising 75 µL of 400 g/L α-ketoglutaric acid [in 50 mM sodium phosphate pH 6.5], 50 µL of 20 mM Mohr's salt in 65 mM ascorbic acid [in 50 mM sodium phosphate pH 6.5], and 200 µL of 200 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 µL of the reaction mix into a 96-well deep-well plate containing 225 µL derivatization solution (comprising 75 µL of saturated sodium bicarbonate, 25 µL water, and 125 µL of 2.5 mg/mL FmocCl [in ACN] per well). After 1 hr of shaking at room temperature, the plate was centrifuged for one minute at 4000 rpm, and 40 µL of the soluble fraction of the quenched reaction were mixed with 160 µL of 1:1 ACN: 0.5M HCl. The derivatized and diluted samples were analyzed as described in Table 13.1. Selectivity relative to SEQ ID NO: 562 (Selectivity FIOP) was calculated as the ratio of trans-3-hydroxyproline: trans-4-hydroxyproline of the product formed by the variant over the ratio produced by SEQ ID NO: 562. The results are shown in Table 10.1.

TABLE 10.1

Selectivity of Variants Relative to SEQ ID NO: 562

| SEQ ID NO: (nt/aa) | Amino Acid Differences (Relative to SEQ ID NO: 562) | FIOP[1] (Selectivity ratio) (Relative to SEQ ID NO: 562) |
|---|---|---|
| 563/564 | K40A | ++ |
| 565/566 | A347K | ++ |
| 567/568 | L179T | ++ |
| 569/570 | I15F | ++ |
| 571/572 | A43S | ++ |
| 573/574 | S164Q | + |
| 575/576 | T345D | + |
| 577/578 | R59L | + |
| 579/580 | Q79E | + |
| 581/582 | S149N | + |
| 583/584 | G44V | + |
| 585/586 | K82A | + |
| 587/588 | G44R | + |

[1]Levels of increased selectivity were determined relative to the reference polypeptide of SEQ ID NO: 562 and defined as follows: "+" 1.00 to 1.10, "++" >1.10

In addition to the HTP analysis, a select subset of beneficial variants from the HTP screening was also prepared in shake flask scale as described in Example 3 with expression at 30° C. Lyophilized shake flask lysate powders (SFP) were tested in 1 mL scale reactions under the following conditions: 60 g/L L-proline, 5 wt % proline hydroxylase variant SFP, 1.2 equiv. a-KG (α-ketoglutaric acid), 10 mM ascorbic acid, 4 mM ammonium iron (II) sulfate hexahydrate, 50 mM sodium phosphate pH 6.8, air, and room temperature. Reactions were run overnight and analyzed using similar methods described above for the HTP reactions. Selectivity relative to SEQ ID NO: 562 (Selectivity FIOP) was calculated as the ratio of trans-3-hydroxyproline: trans-4-hydroxyproline of the product formed by the variant over the ratio produced by SEQ ID NO: 562. The results are shown in Table 10.2.

TABLE 10.2

Selectivity of Variants Relative to SEQ ID NO: 562

| SEQ ID NO: (nt/aa) | Amino Acid Differences (Relative to SEQ ID NO: 562) | FIOP[1] (Selectivity ratio) (Relative to SEQ ID NO: 562) |
|---|---|---|
| 589/590 | A29S; E208S; V228T; N278S; H294T; A347E | + |
| 591/592 | A29S; L85P; S177A; E208S; V228T; A347E | + |
| 593/594 | A29S; S177P; H195Y; V228T; V343T | ++ |
| 595/596 | S56P; H195Y; N278S | + |
| 597/598 | A29S; L85P; E208L; V228T; V343T; A347E | + |
| 599/600 | L85P; C187P; A205S; E208L; N278S | + |
| 601/602 | S113N; S177P; C187P; H195Y; E208S; N278S; H294Y; V343T; A347E | + |
| 603/604 | S177A; A205S; E208L; V228T | + |

[1]Levels of increased selectivity were determined relative to the reference polypeptide of SEQ ID NO: 562 and defined as follows: "+" 1.00 to 1.20, "++" >1.20

Example 11

Improvements Over SEQ ID NO: 598 in the Conversion of Proline Substrate to Trans-3-Hydroxyproline Libraries of engineered genes were produced from the engineered polynucleotide (SEQ ID NO: 597) encoding the polypeptide with proline hydroxylase activity of SEQ ID NO: 598 using well-established techniques (e.g., saturation mutagenesis, and recombination of previously identified beneficial mutations). The polypeptides encoded by each gene were produced in HTP as described in Example 2 (with protein expression overnight at 30° C.). For all variants, the cell pellets were lysed by adding 200 µL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 µL round bottom plate, 50 µL of the E. coli lysates were added to 200 µL of reaction mix (comprising 75 µL of 267 g/L α-ketoglutaric acid [in 50 mM sodium phosphate pH 6.5], 50 µL of 20 mM Mohr's salt in 65 mM ascorbic acid [in 50 mM sodium phosphate pH 6.5], and 200 µL of 133 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 μL of the reaction mix into a 96-well deep-well plate containing 225 μL derivatization solution (comprising 75 μL of saturated sodium bicarbonate, 25 μL water, and 125 μL of 2.5 mg/mL FmocCl [in ACN] per well). After 1 hr of shaking at room temperature, the plate was centrifuged for one minute at 4000 rpm, and 40 μL of the soluble fraction of the quenched reaction were mixed with 160 μL of 1:1 ACN: 0.5M HCl. The derivatized and diluted samples were analyzed as described in Table 13.1. Selectivity relative to SEQ ID NO: 598 (Selectivity FIOP) was calculated as the ratio of trans-3-hydroxyproline: trans-4-hydroxyproline of the product formed by the variant over the ratio produced by SEQ ID NO: 598. The results are shown in Table 11.1.

TABLE 11.1

Selectivity of Variants Relative to SEQ ID NO: 598

| SEQ ID NO: (nt/aa) | Amino Acid Differences (Relative to SEQ ID NO: 598) | FIOP[1] (Selectivity ratio) (Relative to SEQ ID NO: 598) |
| --- | --- | --- |
| 605/606 | V162S | ++ |
| 607/608 | T219V | ++ |
| 609/610 | F47Q | ++ |
| 611/612 | S227R | + |
| 613/614 | C209H | + |
| 615/616 | N342M | + |
| 617/618 | N342L | + |

[1]Levels of increased selectivity were determined relative to the reference polypeptide of SEQ ID NO: 598 and defined as follows: "+" 1.00 to 1.10, "++" >1.10

In addition to the HTP analysis, a select subset of beneficial variants from the HTP screening was also prepared in shake flask scale as described in Example 3 with expression at 30° C. Lyophilized shake flask lysate powders (SFP) were tested in 1 mL scale reactions under the following conditions: 60 g/L L-proline, 5 wt % proline hydroxylase variant SFP, 1.2 equiv. a-KG (α-ketoglutaric acid), 10 mM ascorbic acid, 4 mM ammonium iron (II) sulfate hexahydrate, 50 mM sodium phosphate pH 6.8, air, and room temperature. Reactions were run overnight and analyzed using similar methods described above for the HTP reactions. Selectivity relative to SEQ ID NO: 598 (Selectivity FIOP) was calculated as the ratio of trans-3-hydroxyproline: trans-4-hydroxyproline of the product formed by the variant over the ratio produced by SEQ ID NO: 598. The results are shown in Table 11.2.

TABLE 11.2

Selectivity of Variants Relative to SEQ ID NO: 598

| SEQ ID NO: (nt/aa) | Amino Acid Differences (Relative to SEQ ID NO: 598) | FIOP[1] (Selectivity ratio) (Relative to SEQ ID NO: 598) |
| --- | --- | --- |
| 619/620 | S17V; G44R; T199C; L313C | + |
| 621/622 | G44R; L179T; H195Y; T199C | + |
| 623/624 | S17V; G44V; L179T; H195Y; V250P; L313C; T345D | + |
| 625/626 | G44R; L179T; H195Y; T199C; T345D | + |
| 627/628 | A43S; G44V; H195Y; T199C | + |
| 629/630 | G44V; L179T; H195Y; T199C; T345D | + |
| 631/632 | G44V; S149N; S164Q; T171M; C187P | + |

TABLE 11.2-continued

Selectivity of Variants Relative to SEQ ID NO: 598

| SEQ ID NO: (nt/aa) | Amino Acid Differences (Relative to SEQ ID NO: 598) | FIOP[1] (Selectivity ratio) (Relative to SEQ ID NO: 598) |
| --- | --- | --- |
| 633/634 | S149N; S164Q; T171M; V288T | + |
| 635/636 | C187P; A286P | + |
| 637/638 | K82A; Q163D; S164Q | + |
| 639/640 | K82A; Q163D; S164Q; T171M; C187P; A201V; S203Q; L208I; A286P; V288T; K320V | + |
| 641/642 | Q79E; Q163D; S164Q; T171M; C187N; A201V; A286P; V288T | + |
| 619/620 | S17V; G44R; T199C; L313C | + |
| 621/622 | G44R; L179T; H195Y; T199C | + |
| 623/624 | S17V; G44V; L179T; H195Y; V250P; L313C; T345D | + |

[1]Levels of increased selectivity were determined relative to the reference polypeptide of SEQ ID NO: 598 and defined as follows: "+" 1.00 to 1.10

Example 12

Improvements Over SEQ ID NO: 630 in the Conversion of Proline Substrate to Trans-3-Hydroxyproline Libraries of engineered genes were produced from the engineered polynucleotide (SEQ ID NO: 629) encoding the polypeptide with proline hydroxylase activity of SEQ ID NO: 630 using well-established techniques (e.g., saturation mutagenesis, and recombination of previously identified beneficial mutations). The polypeptides encoded by each gene were produced in HTP as described in Example 2 (with protein expression overnight at 30° C.). For all variants, the cell pellets were lysed by adding 200 μL lysis buffer (containing 50 mM sodium phosphate buffer pH 6.5, 1 g/L lysozyme, and 0.5 g/L PMBS) and shaking at room temperature for 2 hours on table top shaker. The plates were centrifuged at 4000 rpm for 15 minutes at 4° C. to remove cell debris.

In a 300 μL round bottom plate, 50 μL of the E. coli lysates were added to 200 μL of reaction mix (comprising 75 μL of 267 g/L α-ketoglutaric acid [in 50 mM sodium phosphate pH 6.5], 50 μL of 20 mM Mohr's salt in 65 mM ascorbic acid [in 50 mM sodium phosphate pH 6.5], and 200 μL of 133 g/L L-proline) in each well. The plate was sealed with an AirPore seal (Qiagen) and the reaction left to proceed overnight (~18 hours) in a 2" throw Kuhner at 30° C., 200 rpm, and 85% relative humidity.

Following the overnight incubation, the reaction from each well was derivatized and quenched by aliquoting 25 μL of the reaction mix into a 96-well deep-well plate containing 225 μL derivatization solution (comprising 75 μL of saturated sodium bicarbonate, 25 μL water, and 125 μL of 2.5 mg/mL FmocCl [in ACN] per well). After 1 hr of shaking at room temperature, the plate was centrifuged for one minute at 4000 rpm, and 40 μL of the soluble fraction of the quenched reaction were mixed with 160 μL of 1:1 ACN: 0.5M HCl. The derivatized and diluted samples were analyzed as described in Table 13.1. Selectivity relative to SEQ ID NO: 630 (Selectivity FIOP) was calculated as the ratio of trans-3-hydroxyproline: trans-4-hydroxyproline of the product formed by the variant over the ratio produced by SEQ ID NO: 630.

In addition to the HTP analysis, a select subset of beneficial variants from the HTP screening was also prepared in shake flask scale as described in Example 3 with expression at 30° C. Lyophilized shake flask lysate powders (SFP) were tested in 1 mL scale reactions under the following conditions: 60 g/L L-proline, 5 wt % proline hydroxylase variant SFP, 1.2 equiv. a-KG (α-ketoglutaric acid), 10 mM ascorbic acid, 4 mM ammonium iron (II) sulfate hexahydrate, 50 mM sodium phosphate pH 6.8, air, and room temperature. Reactions were run overnight and analyzed using similar methods described above for the HTP reactions. Selectivity relative to SEQ ID NO: 630 (Selectivity FIOP) was calculated as the ratio of trans-3-hydroxyproline: trans-4-hydroxyproline of the product formed by the variant over the ratio produced by SEQ ID NO: 630. The results are shown in Table 12.1.

TABLE 12.1

Selectivity of Variants Relative to SEQ ID NO: 630

| SEQ ID NO: (nt/aa) | Amino Acid Differences (Relative to SEQ ID NO: 630) | FIOP[1] (Selectivity ratio) (Relative to SEQ ID NO: 630) |
|---|---|---|
| 643/644 | V162S; T219V; L313C; M338I | ++ |
| 645/646 | V162S; T236L; N342M | + |
| 647/648 | V162S; L313C; N342M | + |
| 649/650 | V162S | + |
| 651/652 | V162S; T219V; T236L | + |
| 653/654 | S135P; Q163D; S164Q; A201V; S203Q; L208I | + |
| 655/656 | K82A; S164T; T171M; S203Q; L208I | + |
| 657/658 | S164Q; T171M; A201V; S203Q; L282V | + |

[1]Levels of increased selectivity were determined relative to the reference polypeptide of SEQ ID NO: 630 and defined as follows: "+" 1.00 to 1.25, "++" >1.25

Example 13

Analytical Detection of Trans-3-Hydroxyproline Produced from Proline

Data described in Examples 4-12 were collected using analytical methods in Table 13.1. The methods provided herein all find use in analyzing the variants produced using the present invention. However, it is not intended that the methods described herein are the only methods applicable to the analysis of the variants provided herein and/or produced using the methods provided herein.

Proline substrate and hydroxyl proline products were analyzed as described below. Reactions were derivatized and quenched by aliquoting 25 μL of the reaction mix into a 96-well deep-well plate containing 225 μL derivatization solution (comprising 75 μL of saturated sodium bicarbonate, 25 μL water, and 125 μL of 2.5 mg/mL FmocCl [in ACN] per well). After 1 hr of shaking at room temperature, the plate was centrifuged for one minute at 4000 rpm, and 40 μL of the soluble fraction of the quenched reaction were mixed with 160 μL of 1:1 ACN:0.5M HCl. The derivatized and diluted samples were analyzed as described in Table 13.1.

TABLE 13.1

Analytical Method

| Instrument | Thermo Vanquish UHPLC |
|---|---|
| Column | Ascentis Express C-18 3 × 100 mm, 2.7 μm |
| Mobile Phase | (A = 5 mM Ammonium Formate in water, B = 5 mM Ammonium Formate in water and 90% MeCN) |

| Gradient | |
|---|---|
| Time (min) | % B |
| 0.0 | 23 |
| 2.0 | 34 |
| 2.1 | 90 |
| 3.0 | 90 |
| 3.1 | 23 |
| 3.6 | 23 |

| Flow Rate | 0.75 mL/min |
|---|---|
| Run Time | 3.6 min |
| Elution order | Trans-4-hydroxy-proline 1.91 min, Trans-3-hydroxy-proline 2.11 min, Proline 2.78 min |
| Column Temperature | 50° C. |
| Column preheater Temperature | 40° C. |
| Injection Volume | 2.5 μL |
| Detection | UV 254 nm; Detector: MWD |

All publications, patents, patent applications and other documents cited herein are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (658 sequences)

SEQ ID NO: 1 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgccactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 2 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 3 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 4 - protein, 349 aa, Artificial Sequence; identical to SEQ ID NO: 2
  Engineered Variant of Proline Hydroxylase from Fungal sp. No. 11243

SEQ ID NO: 5 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 6 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 7 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgactcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 8 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLTHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 9 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacagagggaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 10 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQREDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 11 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcactgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 12 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRTAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 13 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctccggtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 14 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSPVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 15 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgcttctggt

SEQ ID NO: 16 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAASG

SEQ ID NO: 17 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgccttgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 18 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRLAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 19 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggctgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 20 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQAEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 21 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggaggtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 22 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDAEVMIPERHSLAYFGKPSRDEVVDSLPLFVPEGCKPKFADRWTALEYNQSKLMRTYNVETAAQG

SEQ ID NO: 23 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcaggggaatataaccaatccaaattgatgcgtacatacaacgtcgagactgctgctcagggt

SEQ ID NO: 24 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTAGEYNQSKLMRTYNVETAAQG

SEQ ID NO: 25 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgccgggcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 26 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRRAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 27 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagcatgccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 28 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQHAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 29 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgaggcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 30 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVREAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 31 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtctggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 32 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGLEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 33 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgattcgtacatacaacgtcgagactgctgctcagggt

SEQ ID NO: 34 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLIRTYNVETAAQG

SEQ ID NO: 35 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtgagccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 36 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTREPGDADVMIPERHSLAYFGKPSRDEVVDSLPLFVPEGCKPKFADRWTALEYNQSKLMRTYNVETAAQG

SEQ ID NO: 37 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcggctccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 38 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPAAPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 39 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtggtactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 40 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECGTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 41 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 42 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFVPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 43 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgttcgccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 44 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRSPGDADVMIPERHSLAYFGKPSRDEVVDSLPLFVPEGCKPKFADRWTALEYNQSKLMRTYNVETAAQG

SEQ ID NO: 45 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgtgcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggaggtggatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 46 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDVRVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEVDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 47 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgctcggcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 48 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRSAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 49 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctcttgcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 50 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPLAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 51 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgcgcctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 52 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFAPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 53 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcaggagaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 54 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQENPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 55 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagtttcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 56 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAEFRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 57 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacaatgagactgctgctcagggt

SEQ ID NO: 58 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNNETAAQG

SEQ ID NO: 59 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgatgatcgctggacggcattagaatataaccaatccaaattgatgcgtacatacaacgtcgagactgctgctcagggt

SEQ ID NO: 60 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFDDRWTALEYNQSKLMRTYNVETAAQG

SEQ ID NO: 61 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactgttgcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 62 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATVASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 63 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctagggtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 64 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 65 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgataagtggacggcattagaatataaccaatccaaattgatgcgtacatacaacgtcgagactgctgctcagggt

SEQ ID NO: 66 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADKWTALEYNQSKLMRTYNVETAAQG

SEQ ID NO: 67 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacgctgcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 68 - protein, 349 aa, Artificial Sequence
  Engineered Variant of Proline Hydroxylase from Fungal sp. No. 11243
MGSHHHHHHHHSGSIPSLDYRLFSHGDAAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 69 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgccagacggcattagaatataaccaatccaaattgatgcgtacatacaacgtcgagactgctgctcagggt

SEQ ID NO: 70 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRQTALEYNQSKLMRTYNVETAAQG

SEQ ID NO: 71 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaaccctgagactgctgctcagggt

SEQ ID NO: 72 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNPETAAQG

SEQ ID NO: 73 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgaccagcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 74 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDQHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 75 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttcgcgtatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 76 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFAYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 77 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactagtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 78 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTSLPGDADVMIPERHSLAYFGKPSRDEVVDSLPLFVPEGCKPKFADRWTALEYNQSKLMRTYNVETAAQG

SEQ ID NO: 79 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgataagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 80 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCDKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 81 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcattggacggcattagaatataaccaatccaaattgatgcgtacatacaacgtcgagactgctgctcagggt

SEQ ID NO: 82 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADHWTALEYNQSKLMRTYNVETAAQG

SEQ ID NO: 83 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtagatattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 84 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVDIPERHSLAYFGKPSRDEVVDSLPLFVPEGCKPKFADRWTALEYNQSKLMRTYNVETAAQG

SEQ ID NO: 85 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatgggtggacggcattagaatataaccaatccaaattgatgcgtacatacaacgtcgagactgctgctcagggt

SEQ ID NO: 86 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADGWTALEYNQSKLMRTYNVETAAQG

SEQ ID NO: 87 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccagctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 88 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 89 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcatttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 90 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGHLRSVNHRVVSPTRLPGDADVMIPERHSLAYFGKPSRDEVVDSLPLFVPEGCKPKFADRWTALEYNQSKLMRTYNVETAAQG

SEQ ID NO: 91 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactagtgctcagggt

SEQ ID NO: 92 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETSAQG

SEQ ID NO: 93 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 94 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEIVDSLPLFVPEGCKPKFADRWTALEYNQSKLMRTYNVETAAQG

SEQ ID NO: 95 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggtttcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 96 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWFPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 97 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 98 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQMKLMRTYNVETAAQG

SEQ ID NO: 99 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggacctcgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaagcgaaattgatgcgtacatacaacgtcgagactgctgctcagggt

SEQ ID NO: 100 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQAKLMRTYNVETAAQG

SEQ ID NO: 101 - DNA, 1047 bp, Artificial Sequence; identical to SEQ ID NO: 41
  Engineered Variant of Proline Hydroxylase from Fungal sp. No. 11243

SEQ ID NO: 102 - protein, 349 aa, Artificial Sequence; identical to SEQ ID NO: 42
  Engineered Variant of Proline Hydroxylase from Fungal sp. No. 11243

SEQ ID NO: 103 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactacgttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 104 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDEVVDSLPLFVPEGCKPKFADRWTALEYNQSKLMRTYNVETAAQG

SEQ ID NO: 105 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccaccggacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 106 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPPDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 107 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaactgtcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 108 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGELSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 109 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacacgcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 110 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDTHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 111 - DNA, 1047 bp, Artificial Sequence; identical to SEQ ID NO: 37
  Engineered Variant of Proline Hydroxylase from Fungal sp. No. 11243

SEQ ID NO: 112 - protein, 349 aa, Artificial Sequence; identical to SEQ ID NO: 38
  Engineered Variant of Proline Hydroxylase from Fungal sp. No. 11243

SEQ ID NO: 113 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggaagtggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 114 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGSGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 115 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcctcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcaggga

SEQ ID NO: 116 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 117 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgcgaatcgttggatgcctgatgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 118 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 119 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgctaaactgcgcaatcacgggctgtcagatgagcgtgttgacgaggctttctcttggagtaataaatttttcaatctgccacttcacattaagcagaaggcccctcatcctccggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatccgaatcgttggatgcctgatgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacgaccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 120 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSWSNKFFNLPLHIKQKAPHPPAPNPHRGYSGVGQEKISAITGFEKGERSEVRAAELRESWDQGPADDELYPNRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDDRLRSVNHRVVSPTRLPGDADVMIPERHSLAYFGKPSRDEVVDSLPLFVPEGCKPKFADRWTALEYNQSKLMRTYNVETAAQG

SEQ ID NO: 121 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgcctgttcagccacggtgacccggcccagcgccaacagttctgtgaggaccttgtgaaaacatttgcgggatacggatttgccaaactgcgcaatcacgggctgtcggatgagcgtgttgacgaggctttctcttatagtaataaatttttcaatctgccacttcatattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctttcgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 122 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 123 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcggatgagcgtgttgacgaggctttctcttatagtaataaatttttcaatctgccacttgagattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgttattctattgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 124 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSIAYFGKPSRDEVVDSLPLFVPEGCKPKFADRWTALEYNQSKLMRTYNVETAAQG

SEQ ID NO: 125 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttgagattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctattgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 126 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSIAYFGKPSRDEVVDSLPLFVPEGCKPKFADRWTALEYNQSKLMRTYNVETAAQG

SEQ ID NO: 127 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgcctgttcagccacggtgacccggcccagcgccaacagttctgtgaggaccttgtgaaaacatttgcgggatacggatttgccaaactgcgcaatcacgggctgccggatgagcgtgttgacgaggctttctcttatagtaataaatttttcaatctgccacttgagattaagcagaaggccaagcatcctgaggcaccgaacccacaccgcggctattctggagtgggtcaggagaagatctcagctattaccggtttcgagaaaggcgaacgctcagaggtacgcgccgcagaactgcgcgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgcatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgttattctctggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 128 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLPDERVDEAFSYSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSLAYFGKPSRDEVVDSLPLFVPEGCKPKFADRWTALEYNQSKLMRTYNVETAAQG

SEQ ID NO: 129 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgcctgttcagccacggtgacccggcccagcgccaacagttctgtgaggaccttgtgaaaacatttgcgggatacggatttgccaaactgcgcaatcacgggctgccggatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgcatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcacagcgatttcggcacgattactctgttattccaagatagtgtagggggtttagaagttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgttattctctggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 130 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFAKLRNHGLPDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLEVEDQQNPGVFLPVEPDDVHEMIINVGDCLSRWTDGRLRSVNHRVVSPTRLPGDADVMIPERYSLAYFGKPSRDEVVDSLPLFVPEGCKPKFADRWTALEYNQSKLMRTYNVETAAQG

SEQ ID NO: 131 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgcctgttcagccacggtgacccggcccagcgccaacagttctgtgaggaccttgtgaaaacatttgcgggatacggatttgccaaactgcgcaatcacgggctgccggatgagcgtgttgacgaggctttctcttatagtaataaatttttcaatctgccacttgagattaagcagaaggccaagcatcctgaggcaccgaacccacaccgcggctattctggagtgggtcaggagaagatctcagctattaccggtttcgagaaaggcgaacgctcagaggtacgcgccgcagatctgcgcgaaagctttgaccaaggacctgcggacgatgagctgtatgctaatcgttggatgcctgacgaagatttacctggctttcgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttagaagttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 132 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLPDERVDEAFSYSNKFFNLPLEIKQKAKHPEAPNPHRGYSGVGQEKISAITGFEKGERSEVRAADLRESFDQGPADDELYANRWMPDEDLPGFRSFMESFFVECQTLHQSLLQCIATGLSLPSDELSSRCAKCSAELRLNHYPATPASSLASGACRISPHSDFGTITLLFQDSVGGLEVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 133 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgcctgttcagccacggtgacccggcccagcgccaacagttctgtgaggaccttgtgaaaacatttgcgggatacggatttgccaaactgcgcaatcacgggctgccggatgagcgtgttgacgaggctttctcttatagtaataaatttttcaatctgccacttgagattaagcagaaggccaagcatcctgaggcaccgaacccacaccgcggctattctggagtgggtcaggagaagatctcagctattaccggtttcgagaaaggcgaacgctcagaggtacgcgccgcagaactgcgcgaaagctgggaccaaggacctgcggacgatgagctgtatgctaatcgttggatgcctgacgaagatttacctggctaccgctcttttatggagtcgttcttcgtagaatgtcagactcttcatcagtcgttgttacaggcgctggcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctattgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 134 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFAKLRNHGLPDERVDEAFSYSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQALATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSIAYFGKPSRDEVVDSLPLFVPEGCKPKFADRWTALEYNQSKLMRTYNVETAAQG

SEQ ID NO: 135 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagatctgcgcgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgcatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttacaagttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgttattctattgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 136 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAADLRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSIAYFGKPSRDEVVDSLPLFVPEGCKPKFADRWTALEYNQSKLMRTYNVETAAQG

SEQ ID NO: 137 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcggatgagcgtgttgacgaggctttctcttatagtaataaatttttcaatctgccacttgagattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacaggcgatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttagaagttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgttattctctggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 138 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQAIATGLSLPSDELSSRCAKCSAELRLNHYPATPASSLASGACRISPHSDFGTITLLFQDSVGGLEVEDQQNPGVFLPVEPDDVHEMIINVGDCLSRWTDGRLRSVNHRVVSPTRLPGDADVMIPERYSLAYFGKPSRDEVVDSLPLFVPEGCKPKFADRWTALEYNQSKLMRTYNVETAAQG

SEQ ID NO: 139 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgccaaactgcgcaatcacgggctgtcagatgagcgtgttgacgaggctttctcttatagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgtagcgcagaattgcgtttgaaccactaccctgcgactccggcttcttcattggcgtcaggtgcatgtcgcattagtcctcactctgatttcggcacgattactctgttattccaagatagtgtagggggtttagaagttgaagatcagcaaaatcctggagtgtttttacctgtggagccagatgacgttcatgaaatgattatcaatgtcggggattgtctttcacgttggacagacggtcgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 140 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFAKLRNHGLSDERVDEAFSYSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLNHYPATPASSLASGACRISPHSDFGTITLLFQDSVGGLEVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 141 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacgtgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 142 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRETWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 143 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagctcggaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 144 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSSELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 145 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcgctgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 146 - protein, 349 aa, Artificial Sequence; identical to SEQ ID NO: 118
  Engineered Variant of Proline Hydroxylase from Fungal sp. No. 11243

SEQ ID NO: 147 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggctgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 148 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQAEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 149 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctgtggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 150 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSVAYFGKPSRDEVVDSLPLFVPEGCKPKFADRWTALEYNQSKLMRTYNVETAAQG

SEQ ID NO: 151 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacagatggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 152 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQMEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 153 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgtattaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 154 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLYYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 155 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctctggcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 156 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLPDERVDEAFSWSNKFFNLPLEIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFLPVEPDDVHEMIINVGDCLSRWTDGRLRSVNHRVVSPTRLPGDADVMIPERYSLAYFGKPSRDEIVDSLPLFVPEGCKPKFADRWTALEYNQMKLMRTYNVETAAQG

SEQ ID NO: 157 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctatcgcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 158 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSIAYFGKPSRDEIVDSLPLFVPEGCKPKFADRWTALEYNQMKLMRTYNVETAAQG

SEQ ID NO: 159 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 160 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQMKLMRTYNVETAAQG

SEQ ID NO: 161 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 162 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTRLPGDADVMIPERHSIAYFGKPSRDEIVDSLPLFVPEGCKPKFADRWTALEYNQMKLMRTYNVETAAQG

SEQ ID NO: 163 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctctggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 164 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLPDERVDEAFSWSNKFFNLPLHIKQKAKHPEAPNPHRGYSRVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERYSLAYFGKPSRDEIVDSLPLFVPEGCKPKFADRWTALEYNQSKLMRTYNVETAAQG

SEQ ID NO: 165 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 166 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERYSIAYFGKPSRDEVVDSLPLFVPEGCKPKFADRWTALEYNQSKLMRTYNVETAAQG

SEQ ID NO: 167 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctcctgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctaagggt

SEQ ID NO: 168 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSPVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEIVDSLPLFVPEGCKPKFADRWTALEYNQMKLMRTYNVETAAKG

SEQ ID NO: 169 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctatcgcgtatttcggaaagccatctcgcgacgaactggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 170 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTRLPGDADVMIPERYSIAYFGKPSRDELVDSLPLFVPEGCKPKFADRWTALEYNQMKLMRTYNVETAAQG

SEQ ID NO: 171 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 172 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERYSIAYFGKPSRDEVVDSLPLFVPEGCKPKFADRWTALEYNQSKLMRTYNVETAAQG

SEQ ID NO: 173 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctatcgcgtatttcggaaagccatctcgcgacgaactggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 174 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLPDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSIAYFGKPSRDELVDSLPLFVPEGCKPKFADRWTALEYNQSKLMRTYNVETAAQG

SEQ ID NO: 175 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 176 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLSDERVDEAFSWSNKFFNLPLEIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSIAYFGKPSRDEIVDSLPLFVPEGCKPKFADRWTALEYNQSKLMRTYNVETAAQG

SEQ ID NO: 177 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 178 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLSDERVDEAFSWSNKFFNLPLEIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTSLPGDADVMIPERYSIAYFGKPSRDEVVDSLPLFVPEGCKPKFADRWTALEYNQSKLMRTYNVETAAQG

SEQ ID NO: 179 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctctggcgtatttcggaaagccatctcgcgacgaaattgtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 180 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFVPVEPDDVHEMIINVGDCLSRWTDGRLRSVNHRVVSPTTLPGDADVMIPERYSLAYFGKPSRDEIVDSLPLFVPEGCKPKFADRWTALEYNQSKLMRTYNVETAAQG

SEQ ID NO: 181 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 182 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDEIVDSLPLFVPEGCKPKFADRWTALEYNQSKLMRTYNVETAAQG

SEQ ID NO: 183 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 184 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQAEDQQNPGVFVPVEPDDVHEMIINVGDCLSRWTDGRLRSVNHRVVSPTSLPGDADVMIPERHSIAYFGKPSRDEIVDSLPLFVPEGCKPKFADRWTALEYNQMKLMRTYNVETAAQG

SEQ ID NO: 185 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctctggcgtatttcggaaagccatctcgcgacgaactggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 186 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSLAYFGKPSRDELVDSLPLFVPEGCKPKFADRWTALEYNQSKLMRTYNVETAAQG

SEQ ID NO: 187 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggcggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctatcgcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 188 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEAEDQQNPGVFLPVEPDDVHEMIINVGDCLSRWTDGRLRSVNHRVVSPTTLPGDADVMIPERYSIAYFGKPSRDEIVDSLPLFVPEGCKPKFADRWTALEYNQSKLMRTYNVETAAQG

SEQ ID NO: 189 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 190 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTSLPGDADVMIPERHSLAYFGKPSRDEIVDSLPLFVPEGCKPKFADRWTALEYNQMKLMRTYNVETAAQG

SEQ ID NO: 191 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 192 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEIVDSLPLFVPEGCKPKFADRWTALEYNQSKLMRTYNVETAAQG

SEQ ID NO: 193 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 194 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFLPVEPDDVHEMIINVGDCLSRWTDGRLRSVNHRVVSPTSLPGDADVMIPERYSIAYFGKPSRDEVVDSLPLFVPEGCKPKFADRWTALEYNQSKLMRTYNVETAAQG

SEQ ID NO: 195 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctctggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 196 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQAEDQQNPGVFLPVEPDDVHEMIINVGDCLSRWTDGRLRSVNHRVVSPTRLPGDADVMIPERYSLAYFGKPSRDEIVDSLPLFVPEGCKPKFADRWTALEYNQSKLMRTYNVETAAQG

SEQ ID NO: 197 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctctggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 198 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQAEDQQNPGVFVPVEPDDVHEMIINVGDCLSRWTDGRLRSVNHRVVSPTRLPGDADVMIPERYSLAYFGKPSRDEVVDSLPLFVPEGCKPKFADRWTALEYNQSKLMRTYNVETAAQG

SEQ ID NO: 199 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacagcgtgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctctggcgtatttcggaaagccatctcgcgacgaactggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 200 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQREDQQNPGVFLPVEPDDVHEMIINVGDCLSRWTDGRLRSVNHRVVSPTTLPGDADVMIPERYSLAYFGKPSRDELVDSLPLFVPEGCKPKFADRWTALEYNQSKLMRTYNVETAAQG

SEQ ID NO: 201 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 202 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTSLPGDADVMIPERYSIAYFGKPSRDEVVDSLPLFVPEGCKPKFADRWTALEYNQSKLMRTYNVETAAQG

SEQ ID NO: 203 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaactggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 204 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTSLPGDADVMIPERHSLAYFGKPSRDELVDSLPLFVPEGCKPKFADRWTALEYNQSKLMRTYNVETAAQG

SEQ ID NO: 205 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 206 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSIAYFGKPSRDEVVDSLPLFVPEGCKPKFADRWTALEYNQSKLMRTYNVETAAQG

SEQ ID NO: 207 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagagcgtgaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctatcgcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 208 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEREDQQNPGVFVPVEPDDVHEMIINVGDCLSRWTDGRLRSVNHRVVSPTRLPGDADVMIPERYSIAYFGKPSRDEIVDSLPLFVPEGCKPKFADRWTALEYNQSKLMRTYNVETAAQG

SEQ ID NO: 209 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtctgaagtgcagcgccgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 210 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCLKCSAELRLLHYPATPASSLASGACRISPHSDFGTITLLFQDSVGGLEVEDQQNPGVFLPVEPDDVHEMIINVGDCLSRWTDGRLRSVNHRVVSPTTLPGDADVMIPERHSIAYFGKPSRDEVVDSLPLFVPEGCKPKFADRWTALEYNQSKLMRTYNVETAAQG

SEQ ID NO: 211 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctctggcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 212 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERYSLAYFGKPSRDEVVDSLPLFVPEGCKPKFADRWTALEYNQSKLMRTYNVETAAQG

SEQ ID NO: 213 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttgaaattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacagcgtgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctctggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 214 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQREDQQNPGVFLPVEPDDVHEMIINVGDCLSRWTDGRLRSVNHRVVSPTRLPGDADVMIPERYSLAYFGKPSRDEIVDSLPLFVPEGCKPKFADRWTALEYNQSKLMRTYNVETAAQG

SEQ ID NO: 215 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctctggcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 216 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTRLPGDADVMIPERYSLAYFGKPSRDEVVDSLPLFVPEGCKPKFADRWTALEYNQSKLMRTYNVETAAQG

SEQ ID NO: 217 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctctggcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 218 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERYSLAYFGKPSRDEVVDSLPLFVPEGCKPKFADRWTALEYNQSKLMRTYNVETAAQG

SEQ ID NO: 219 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacagcgtgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcactctctggcgtatttcggaaagccatctcgcgacgaactggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 220 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQREDQQNPGVFLPVEPDDVHEMIINVGDCLSRWTDGRLRSVNHRVVSPTTLPGDADVMIPERHSLAYFGKPSRDELVDSLPLFVPEGCKPKFADRWTALEYNQMKLMRTYNVETAAQG

SEQ ID NO: 221 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctctggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 222 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTTLPGDADVMIPERYSLAYFGKPSRDEVVDSLPLFVPEGCKPKFADRWTALEYNQSKLMRTYNVETAAQG

SEQ ID NO: 223 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctcctgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgttactctctggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 224 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLPDERVDEAFSWSNKFFNLPLHIKQKAKHPEAPNPHRGYSPVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERYSLAYFGKPSRDEVVDSLPLFVPEGCKPKFADRWTALEYNQSKLMRTYNVETAAQG

SEQ ID NO: 225 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctctggcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 226 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERYSLAYFGKPSRDEVVDSLPLFVPEGCKPKFADRWTALEYNQSKLMRTYNVETAAQG

SEQ ID NO: 227 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 228 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 229 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcgccgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 230 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSAELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSIAYFGKPSRDEVVDSLPLFVPEGCKPKFADRWTALEYNQSKLMRTYNVETAAQG

SEQ ID NO: 231 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 232 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTSLPGDADVMIPERHSLAYFGKPSRDEVVDSLPLFVPEGCKPKFADRWTALEYNQSKLMRTYNVETAAQG

SEQ ID NO: 233 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 234 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQMKLMRTYNVETAAQG

SEQ ID NO: 235 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 236 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDEVVDSLPLFVPEGCKPKFADRWTALEYNQSKLMRTYNVETAAQG

SEQ ID NO: 237 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 238 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 239 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 240 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSIAYFGKPSRDEVVDSLPLFVPEGCKPKFADRWTALEYNQSKLMRTYNVETAAQG

SEQ ID NO: 241 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctcctgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 242 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSPVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFLPVEPDDVHEMIINVGDCLSRWTDGRLRSVNHRVVSPTTLPGDADVMIPERYSIAYFGKPSRDEVVDSLPLFVPEGCKPKFADRWTALEYNQSKLMRTYNVETAAQG

SEQ ID NO: 243 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcactctctggcgtatttcggaaagccatctcgcgacgaactggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 244 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQAEDQQNPGVFVPVEPDDVHEMIINVGDCLSRWTDGRLRSVNHRVVSPTSLPGDADVMIPERHSLAYFGKPSRDELVDSLPLFVPEGCKPKFADRWTALEYNQSKLMRTYNVETAAQG

SEQ ID NO: 245 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 246 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLEIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFVPVEPDDVHEMIINVGDCLSRWTDGRLRSVNHRVVSPTTLPGDADVMIPERHSLAYFGKPSRDEVVDSLPLFVPEGCKPKFADRWTALEYNQSKLMRTYNVETAAQG

SEQ ID NO: 247 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcactctctggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 248 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFLPVEPDDVHEMIINVGDCLSRWTDGRLRSVNHRVVSPTRLPGDADVMIPERHSLAYFGKPSRDEIVDSLPLFVPEGCKPKFADRWTALEYNQSKLMRTYNVETAAQG

SEQ ID NO: 249 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcactctctggcgtatttcggaaagccatctcgcgacgaaattgtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 250 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLPDERVDEAFSWSNKFFNLPLEIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTSLPGDADVMIPERHSLAYFGKPSRDEIVDSLPLFVPEGCKPKFADRWTALEYNQSKLMRTYNVETAAQG

SEQ ID NO: 251 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccgtgatagtgtagggggtttagaggcggaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgttactctatcgcgtatttcggaaagccatctcgcgacgaactggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 252 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLPDERVDEAFSWSNKFFNLPLEIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFRDSVGGLEAEDQQNPGVFLPVEPDDVHEMIINVGDCLSRWTDGRLRSVNHRVVSPTSLPGDADVMIPERYSIAYFGKPSRDELVDSLPLFVPEGCKPKFADRWTALEYNQMKLMRTYNVETAAQG

SEQ ID NO: 253 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 254 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQAEDQQNPGVFLPVEPDDVHEMIINVGDCLSRWTDGRLRSVNHRVVSPTTLPGDADVMIPERHSIAYFGKPSRDEIVDSLPLFVPEGCKPKFADRWTALEYNQSKLMRTYNVETAAQG

SEQ ID NO: 255 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacagcgtgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgttactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 256 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQREDQQNPGVFLPVEPDDVHEMIINVGDCLSRWTDGRLRSVNHRVVSPTSLPGDADVMIPERYSIAYFGKPSRDEVVDSLPLFVPEGCKPKFADRWTALEYNQSKLMRTYNVETAAQG

SEQ ID NO: 257 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 258 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQMKLMRTYNVETAAQG

SEQ ID NO: 259 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcgccgaattgcgtttgctgcactaccctgcgactccggcttcttcattggcgtcaggtgcatgtcgcattagtcctcactctgatttcggcacgattactctgttattccaagatagtgtagggggtttacagcgtgaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcactctctggcgtatttcggaaagccatctcgcgacgaaattgtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 260 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSAELRLLHYPATPASSLASGACRISPHSDFGTITLLFQDSVGGLQREDQQNPGVFVPVEPDDVHEMIINVGDCLSRWTDGRLRSVNHRVVSPTTLPGDADVMIPERHSLAYFGKPSRDEIVDSLPLFVPEGCKPKFADRWTALEYNQSKLMRTYNVETAAQG

SEQ ID NO: 261 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagagcgtgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgttactctctggcgtatttcggaaagccatctcgcgacgaactggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 262 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEREDQQNPGVFLPVEPDDVHEMIINVGDCLSRWTDGRLRSVNHRVVSPTSLPGDADVMIPERYSLAYFGKPSRDELVDSLPLFVPEGCKPKFADRWTALEYNQSKLMRTYNVETAAQG

SEQ ID NO: 263 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcactctatcgcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 264 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQAEDQQNPGVFVPVEPDDVHEMIINVGDCLSRWTDGRLRSVNHRVVSPTTLPGDADVMIPERHSIAYFGKPSRDEVVDSLPLFVPEGCKPKFADRWTALEYNQSKLMRTYNVETAAQG

SEQ ID NO: 265 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttgaaattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 266 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEIVDSLPLFVPEGCKPKFADRWTALEYNQSKLMRTYNVETAAQG

SEQ ID NO: 267 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 268 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFLPVEPDDVHEMIINVGDCLSRWTDGRLRSVNHRVVSPTSLPGDADVMIPERHSLAYFGKPSRDEVVDSLPLFVPEGCKPKFADRWTALEYNQSKLMRTYNVETAAQG

SEQ ID NO: 269 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaactggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 270 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDELVDSLPLFVPEGCKPKFADRWTALEYNQSKLMRTYNVETAAQG

SEQ ID NO: 271 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 272 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFVPVEPDDVHEMIINVGDCLSRWTDGRLRSVNHRVVSPTSLPGDADVMIPERHSLAYFGKPSRDEVVDSLPLFVPEGCKPKFADRWTALEYNQSKLMRTYNVETAAQG

SEQ ID NO: 273 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctcctgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaactggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 274 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSPVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFVPVEPDDVHEMIINVGDCLSRWTDGRLRSVNHRVVSPTSLPGDADVMIPERHSLAYFGKPSRDELVDSLPLFVPEGCKPKFADRWTALEYNQSKLMRTYNVETAAQG

SEQ ID NO: 275 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcactctctggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 276 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEIVDSLPLFVPEGCKPKFADRWTALEYNQSKLMRTYNVETAAQG

SEQ ID NO: 277 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 278 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFVPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 279 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaactggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 280 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDELVDSLPLFVPEGCKPKFADRWTALEYNQSKLMRTYNVETAAQG

SEQ ID NO: 281 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaactggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 282 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDELVDSLPLFVPEGCKPKFADRWTALEYNQSKLMRTYNVETAAQG

SEQ ID NO: 283 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 284 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDEIVDSLPLFVPEGCKPKFADRWTALEYNQSKLMRTYNVETAAQG

SEQ ID NO: 285 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 286 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 287 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 288 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFLPVEPDDVHEMIINVGDCLSRWTDGRLRSVNHRVVSPTTLPGDADVMIPERHSLAYFGKPSRDEVVDSLPLFVPEGCKPKFADRWTALEYNQSKLMRTYNVETAAQG

SEQ ID NO: 289 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 290 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTSLPGDADVMIPERHSLAYFGKPSRDEVVDSLPLFVPEGCKPKFADRWTALEYNQSKLMRTYNVETAAQG

SEQ ID NO: 291 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttctgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 292 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDEIVDSLPLFVPEGCKPKFADRWTALEYNQSKLMRTYNVETAAQG

SEQ ID NO: 293 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 294 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTSLPGDADVMIPERHSLAYFGKPSRDEVVDSLPLFVPEGCKPKFADRWTALEYNQSKLMRTYNVETAAQG

SEQ ID NO: 295 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggcgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttagaggtggaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgcgagatgcggatgtaatgattccagaacgtcactctctggcgtatttcggaaagccatctcgcgacgaaattgtagatagccttccactgttcgtgccagaaggttgtaagcctaaattcgctgatcgctggacggcattagaatataaccaatcgaaattgatgcgtacatacaacgtcgagactgctgctcagggt

SEQ ID NO: 296 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLEVEDQQNPGVFLPVEPDDVHEMIINVGDCLSRWTDGRLRSVNHRVVSPTRLPRDADVMIPERHSLAYFGKPSRDEIVDSLPLFVPEGCKPKFADRWTALEYNQSKLMRTYNVETAAQG

SEQ ID NO: 297 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctcgtgtgggtcaggagaagatctcagctattaccggtttcgagaaaggcgaacgctcagaggtacgcgccgcagagccgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 298 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSRVGQEKISAITGFEKGERSEVRAAEPRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 299 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 300 - protein, 349 aa, Artificial Sequence
  Engineered Variant of Proline Hydroxylase from Fungal sp. No. 11243
MGSHHHHHHHHSGSIPSLDFRLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 301 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcgtctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccgtgatagtgtagggggtttagaggtggaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactagtttaccgggagatgcggatgtaatgattccagaacgtcactctatcgcgtatttcggaaagccatctcgcgacgaactggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 302 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGFRSFMESFFVECQTLHQSLLQCIATGLSLPSDELSSRCAKCSNELRLLHYPATPASSLASGACRISPHSDFGTITLLFRDSVGGLEVEDQQNPGVFVPVEPDDVHEMIINVGDCLSRWTDGRLRSVNHRVVSPTSLPGDADVMIPERHSIAYFGKPSRDELVDSLPLFVPEGCKPKFADRWTALEYNQMKLMRTYNVETAAQG

SEQ ID NO: 303 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctactctcgtgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 304 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLPDERVDEAFSWSNKFFNLPLHIKQKAKHPEAPNPHRGYSRVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTTLPGDADVMIPERHSLAYFGKPSRDEVVDSLPLFVPEGCKPKFADRWTALEYNQSKLMRTYNVETAAQG

SEQ ID NO: 305 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttcacattaagcagaaggccaagcatcctgaggcaccgaacccacaccgcggctattctcctgtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 306 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSPVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQMKLMRTYNVETAAQG

SEQ ID NO: 307 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaaattgtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 308 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEIVDSLPLFVPEGCKPKFADRWTALEYNQSKLMRTYNVETAAQG

SEQ ID NO: 309 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccgacccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 310 - protein, 349 aa, Artificial Sequence
  Engineered Variant of Proline Hydroxylase from Fungal sp. No. 11243
MGSHHHHHHHHSGSIPSLDYRLFSHGDPTQRQQFCEDLVKTFAGYGFVKLRNHGLSDERVDEAFSWSNKFFNLPLEIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDEVVDSLPLFVPEGCKPKFADRWTALEYNQSKLMRTYNVETAAQG

SEQ ID NO: 311 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactttcaactgttcagccacggtgacccggcccagcgccaacagttctgtgaggaccttgtgaaaacatttgcgggatacggatttgttaaactgcgcaatcacgggctgccggatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 312 - protein, 349 aa, Artificial Sequence
  Engineered Variant of Proline Hydroxylase from Fungal sp. No. 11243
MGSHHHHHHHHSGSIPSLDFQLFSHGDPAQRQQFCEDLVKTFAGYGFVKLRNHGLPDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTRLPGDADVMIPERHSLAYFGKPSRDEVVDSLPLFVPEGCKPKFADRWTALEYNQSKLMRTYNVETAAQG

SEQ ID NO: 313 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactaccgcctgttcagccacggtgacccggcccagcgccaacagttctgtgaggaccttgtgaaaacatttgcgggatacggatttgttaaactgcgcaatcacgggctgtcagatgagcgtgttgacgaggctttctcttggagtaataaatttttcaatctgccacttcacattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaagctgggaccaaggacctgcggacgatgagctgtatgctaatcgttggatgcctgacgaagatttacctggctaccgctcttttatggagtcgttcttcgtagaatgtcagactcttcatcagtcgttgttacagtgtatcgcgacgggcttaagtctgccatctgacgagctttcctcacgttgtgcgaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttttacctgtggagccagatgacgttcatgaaatgattatcaatgtcggggattgtcttagtcgttggacagacggccgtttacgttcagtcaatcatcgcgttgtctctccaactacgttaccgggagatgcggatgtaatgattccagaacgtcattctttggcgtatttcggaaagccatctcgcgacgaagtggtagatagccttccactgttcgtgccagaaggttgtaagcctaaattcgctgatcgctggacggcattagaatataaccaatccaaattgatgcgtacatacaacgtcgagactgctgctcagggt

SEQ ID NO: 314 - protein, 349 aa, Artificial Sequence
  Engineered Variant of Proline Hydroxylase from Fungal sp. No. 11243
MGSHHHHHHHHSGSIPSLDYRLFSHGDPAQRQQFCEDLVKTFAGYGFVKLRNHGLSDERVDEAFSWSNKFFNLPLHIKQKAKHPEAPNPHRGYSGVGQEKISAITGFEKGERSEVRAAELRESWDQGPADDELYANRWMPDEDLPGYRSFMESFFVECQTLHQSLLQCIATGLSLPSDELSSRCAKCSNELRLLHYPATPASSLASGACRISPHSDFGTITLLFQDSVGGLQVEDQQNPGVFLPVEPDDVHEMIINVGDCLSRWTDGRLRSVNHRVVSPTTLPGDADVMIPERHSLAYFGKPSRDEVVDSLPLFVPEGCKPKFADRWTALEYNQSKLMRTYNVETAAQG

SEQ ID NO: 315 - DNA, 1047 bp, Artificial Sequence
  Engineered Variant of Proline Hydroxylase from Fungal sp. No. 11243
atgggctctcatcaccaccaccatcatcatcacagcggttcaattccaagtttagactatcaactgttcagccacggtgacccggcccagcgccaacagttctgtgaggaccttgtgaaaacatttgcgggaagtggatttgttaaactgcgcaatcacgggctgtcggatgagcgtgttgacgaggctttctcttggagtaataaatttttcaatctgccacttgaaattaagcagaaggccaagcatcctgaagcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcagaaccctggagtgtttgtgcctgtggagccagatgacgttcatgaaatgattatcaatgtcggggattgtcttagtcgttggacagacggccgtttacgttcagtcaatcatcgcgttgtctctccaactcgtctgccgggagatgcggatgtaatgattccagaacgtcactctatcgcgtatttcggaaagccatctcgcgacgaaattgtagatagccttccactgttcgtgccagaaggttgtaagcctaaattcgccgatggttggacggcattagaatataaccaaatgaaattgatgcgtacatacaacgtcgagactgctgctcagggt

SEQ ID NO: 316 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGSGFVKLRNHGLSDERVDEAFSWSNKFFNLPLEIKQKAKHPEAPNPHRGYSGVGQEKISAITGFEKGERSEVRAAELRETWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTRLPGDADVMIPERHSIAYFGKPSRDEIVDSLPLFVPEGCKPKFADGWTALEYNQMKLMRTYNVETAAQG

SEQ ID NO: 317 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaagccaagcatcctctggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcagcagaaccctggagtgtttgtgcctgtggagccagatgacgttcatgaaatgattatcaatgtcggggattgtcttagtcgttggacagacggccgtttacgttcagtcaatcatcgcgttgtctctccaactacgtcgccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 318 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRAAELRETWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTTSPGDADVMIPERHSIAYFGKPSRDEIVDSLPLFVPEGCKPKFADRWTALEYNQMKLMRTYNVETAAQG

SEQ ID NO: 319 - DNA, 1047 bp, Artificial Sequence
  Engineered Variant of Proline Hydroxylase from Fungal sp. No. 11243
atgctgtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggtggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaaatgaaattgatgcgtacatacaacgtcgagactgctgctcagggt

SEQ ID NO: 320 - protein, 349 aa, Artificial Sequence
  Engineered Variant of Proline Hydroxylase from Fungal sp. No. 11243
MLSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRAAELRETWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQENPGVFVPVEPDDVHEMIINVGDCLSRWTDGRLRSVNHRVVSPTRLPGDADVMIPERHSIAYFGKPSRDEIVDSLPLFVPEGCKPKFADRWTALEYNQMKLMRTYNVETAAQG

SEQ ID NO: 321 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 322 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 323 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggtgtgggtcaggagaagatctcagctattaccggtttcgagaaaggcgaacgctcagaggtacgcgccgcagagctgcgtgaaacctgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcggctgtagcttcttcattggcgtcaggtgcatgtcgcattagtcctcactctgatttcggcacgattactctgttattccaagatagtgtagggggtttacaggttgaagatcagcaaaatcctggagtgtttgtccctgtggagctggatgaccagcatgaaatgattatcaatgtcggggattgtcttagtcgttggacagacggccgtttacgttcagtcaatcatcgcgttgtctctccaactcgtttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcactggaatataaccaaatgaaattgatccgtacatacaacgtcgagactgctgctcagggt

SEQ ID NO: 324 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWMPDEDLPGFRSFMESFFVECQTLHQSLLQCIATGLSLPSDELSSRCAKCSNELRLLHYPAAVASSLASGACRISPHSDFGTITLLFQDSVGGLQVEDQQNPGVFVPVELDDQHEMIINVGDCLSRWTDGRLRSVNHRVVSPTRLPGDADVMIPERHSIAYFGKPSRDEIVDSLPLFVPEGCKPKFADRWTALEYNQMKLIRTYNVETAAQG

SEQ ID NO: 325 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttccgttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtgcgcgtggcagagatccgtgaaacgtgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtcttagtcgttggacagacggccgtttacgttcagtcaatcatcgcgttgtctctccaactcgtttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaaatgaaattgatgcgtacatacaacaatgagactggggctcaaggt

SEQ ID NO: 326 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFRWSNKFFNLPLEIKQKAKHPEAPNPHRGYSGVGQEKISAITGFEKGERSEVRVAEIRETWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGRLRSVNHRVVSPTRLPGDADVMIPERHSIAYFGKPSRDEIVDSLPLFVPEGCKPKFADRWTALEYNQMKLMRTYNNETGAQG

SEQ ID NO: 327 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagggacccgcacggcagagccgcgtgaaacgtgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtcttagtcgttggacagacggcactttacgtgcggtcaatcatcgcgttgtctctccaactcgtttaccgggagatgcggatgtaatgattccagaacgtcactctatcgcgtatttcggaaagccatctcgcgacgaaattgtagatagccttccattcttcgtgccagaaggttgtaagcctaaattcgctgatggttggacggcattagaatataaccaaatgaaattgatgcgtacatacaacaatgagacttcggctcaaggt

SEQ ID NO: 328 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSGTRTAEPRETWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGTLRAVNHRVVSPTRLPGDADVMIPERHSIAYFGKPSRDEIVDSLPFFVPEGCKPKFADGWTALEYNQMKLMRTYNNETSAQG

SEQ ID NO: 329 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacgcagcccagcgccaacagttctgtgaggaccttgtgaaaacatttgcgggatacggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagagacccgcgtggcagagatccgtgaaacgtgggaccaaggacctgcggacgatgagctgtatgctaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggttgaagatcagcaaaatcctggagtgtttgtgcctgtggagccagatgacgttcatgaaatgattatcaatgtcggggattgtcttagtcgttggacagacggcactttactgtcggtcaatcatcgcgttgtctctccaactcgtttaccgggagatgcggatgtaatgattccagaacgtcactctatcgcgtatttcggaaagccatctcgcgacgaaattgtagatagccttccactgttcgtgccagaaggttgtaagcctaaattcgctgatcgctggacggcattagaatataaccaaatgaaattgatgcgtacatacaacaatgagacttcggctagtggt

SEQ ID NO: 330 - protein, 349 aa, Artificial Sequence
  Engineered Variant of Proline Hydroxylase from Fungal sp. No. 11243
MGSHHHHHHHHSGSIPSLDYQLFSHGDAAQRQQFCEDLVKTFAGYGFVKLRNHGLSDERVDEAFSWSNKFFNLPLEIKQKAKHPEAPNPHRGYSGVGQEKISAITGFEKGERSETRVAEIRETWDQGPADDELYANRWMPDEDLPGFRSFMESFFVECQTLHQSLLQCIATGLSLPSDELSSRCAKCSNELRLLHYPATPASSLASGACRISPHSDFGTITLLFQDSVGGLQVEDQQNPGVFVPVEPDDVHEMIINVGDCLSRWTDGTLLSVNHRVVSPTRLPGDADVMIPERHSIAYFGKPSRDEIVDSLPLFVPEGCKPKFADRWTALEYNQMKLMRTYNNETSASG

SEQ ID NO: 331 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagctcggaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 332 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSSELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 333 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtaccgggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 334 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSTGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 335 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttgtgcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 336 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLVRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 337 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgcgtctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 338 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVASPTMSPGDADVDIPERHSIAYFGKPSRDEIVDSLPLFVPEGCKPKFQDGWTALEYNQMKLMRTYNVETAAQG

SEQ ID NO: 339 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacaatgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 340 - protein, 349 aa, Artificial Sequence
  Engineered Variant of Proline Hydroxylase from Fungal sp. No. 11243
MGSHHHHHHHHSGSIPSLDYQLFSHNDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 341 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttcatgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 342 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVHEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 343 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccgtgttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 344 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPCSSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 345 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccgacttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 346 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPTSSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 347 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagttctccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 348 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSSPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 349 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatacggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 350 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDTENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 351 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtgtgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 352 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSVPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 353 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatcctctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 354 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDPLYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 355 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctattgacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 356 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPIDDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 357 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcatctaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 358 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSSNHRVVSPTMSPGDADVDIPERHSIAYFGKPSRDEIVDSLPLFVPEGCKPKFQDGWTALEYNQMKLMRTYNVETAAQG

SEQ ID NO: 359 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcagtgaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 360 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFSECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 361 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagcgggctgctcagggt

SEQ ID NO: 362 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVERAAQG

SEQ ID NO: 363 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggggtcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 364 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPGSSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 365 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattggtgaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 366 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIGERHSIAYFGKPSRDEIVDSLPLFVPEGCKPKFQDGWTALEYNQMKLMRTYNVETAAQG

SEQ ID NO: 367 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcaccctctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 368 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHPLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 369 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccaagggacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 370 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPRDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 371 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgcggttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 372 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRGFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 373 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcaagtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 374 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGASRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 375 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtcaatccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 376 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVNPTMSPGDADVDIPERHSIAYFGKPSRDEIVDSLPLFVPEGCKPKFQDGWTALEYNQMKLMRTYNVETAAQG

SEQ ID NO: 377 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgagcagggt

SEQ ID NO: 378 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAEQG

SEQ ID NO: 379 - DNA, 1047 bp, Artificial Sequence; identical to SEQ ID NO: 355
  Engineered Variant of Proline Hydroxylase from Fungal sp. No. 11243

SEQ ID NO: 380 - protein, 349 aa, Artificial Sequence; identical to SEQ ID NO: 356
  Engineered Variant of Proline Hydroxylase from Fungal sp. No. 11243

SEQ ID NO: 381 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatctcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 382 - protein, 349 aa, Artificial Sequence; identical to SEQ ID NO: 374
  Engineered Variant of Proline Hydroxylase from Fungal sp. No. 11243

SEQ ID NO: 383 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatctgtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 384 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHLSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 385 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttactggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 386 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFTGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 387 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatactcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 388 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDTRVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 389 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaacttttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 390 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDELLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 391 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagcaagggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 392 - protein, 349 aa, Artificial Sequence
  Engineered Variant of Proline Hydroxylase from Fungal sp. No. 11243
MGSHHHHHHHHSGSIPSLDYQLFSKGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 393 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgatgaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 394 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFDECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 395 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagactaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 396 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKTKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 397 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgataatctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 398 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDNLYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 399 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcactcgctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 400 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHSLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 401 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcgccgcagagctgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgaccttctttcctcacgttgtgccaagtgcagcaacgaattgcgtttgctgcactaccctgcgactccggcttcttcattggcgtcaggtgcatgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 402 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRAAELRETWDQGPADDELYANRWFPDEDLPGFRSFMESFFVECQTLHQSLLQCIATGLSLPSDLLSSRCAKCSNELRLLHYPATPASSLASGACRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 403 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcgtagcagagattcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttactgtcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattcgctgatggttggacggcattagaatataaccaaatgaaattgatgcgtacatacaacaatgagactggcgctcagggt

SEQ ID NO: 404 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRVAEIRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLLSVNHRVVSPTMSPGDADVDIPERHSIAYFGKPSRDEIVDSLPLFVPEGCKPKFADGWTALEYNQMKLMRTYNNETGAQG

SEQ ID NO: 405 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagctgcgtgaaacctgggaccaaggacctgcggacgatgagctgtattcgaatcgttggatgcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 406 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAELRETWDQGPADDELYSNRWMPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTMSPGDADVDIPERHSIAYFGKPSRDEIVDSLPLFVPEGCKPKFQDGWTALEYNQMKLMRTYNVETAAQG

SEQ ID NO: 407 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcttggagtaataaatttttcaatctgccacttgaaattaagcagaaggccaagcatcctgaggcaccgaacccacaccgcggctattctggagtgggtcaggagaagatctcagctattaccggtttcgagaaaggcgaacgctcagaggtacgcaccgcagagattcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcggaagatcaggagaaccctggagtgtttgtgcctgtggagccagatgacgttcatgaaatgattatcaatgtcggggattgtcttagtcgttggacagacggccgtttactgtcagtcaatcatcgcgttgtctctccaactatgtcgccgggagatgcggatgtagatattccagaacgtcactctatcgcgtatttcggaaagccatctcgcgacgaaattgtagatagccttccactgttcgtgccagaaggttgtaagcctaaattcgctgatggttggacggcattagaatataaccaaatgaaattgatgcgtacatacaacaatgagactggcgctcagggt

SEQ ID NO: 408 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPEAPNPHRGYSGVGQEKISAITGFEKGERSEVRTAEIRETWDQGPADDELYANRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLLSVNHRVVSPTMSPGDADVDIPERHSIAYFGKPSRDEIVDSLPLFVPEGCKPKFADGWTALEYNQMKLMRTYNNETGAQG

SEQ ID NO: 409 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcgtagcagagccgcgtgaaacctgggaccaaggacctgcggacgatgagctgtatgcgaatcgttggtttcctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgcgtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttactgtcagtcaatcatcgcgttgtctctccaactcgcagtccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgccgctcagggt

SEQ ID NO: 410 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRVAEPRETWDQGPADDELYANRWFPDEDLPGFRSFMESFFVECQTLHQSLLQCIATGLSLPSDELSSRCAKCSNELRLLHYPATPASSLASGACRISPHSDFGTITLLFQDSVGGLQAEDQENPGVFVPVEPDDVHEMIINVGDCLSRWTDGRLLSVNHRVVSPTRSPGDADVMIPERHSIAYFGKPSRDEIVDSLPLFVPEGCKPKFQDGWTALEYNQMKLMRTYNVETAAQG

SEQ ID NO: 411 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 412 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 413 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttctgcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 414 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLLQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 415 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttgttcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 416 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLVQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 417 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttgttcagtcgttgttacagtgtatcgcgacgggcttaagtctgccatctgacgagctttcctcacgttgtgccaagtgcagcaacgaattgcgtttgctgcactaccctgcgactccggcttcttcatcggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 418 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLVQSLLQCIATGLSLPSDELSSRCAKCSNELRLLHYPATPASSSASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 419 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttatgcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 420 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLMQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 421 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttgcgcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 422 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLAQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 423 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcaggatttgttacagtgtatcgcgacgggcttaagtctgccatctgacgagctttcctcacgttgtgccaagtgcagcaacgaattgcgtttgctgcactaccctgtgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgtgtggtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 424 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQDLLQCIATGLSLPSDELSSRCAKCSNELRLLHYPVTPASSLASGECRISPHSDFGTITLLFQDSVGGLQAEDQENPGVFVPVEPDDVHEMIINVGDCLSRWTDGRLRVVNHRVVSPTRLPGDADVMIPERHSIAYFGKPSRDEIVDSLPLFVPEGCKPKFQDGWTALEYNQMKLMRTYNVETAAQG

SEQ ID NO: 425 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtacggcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 426 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCTATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 427 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgtgtggtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 428 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRVVNHRVVSPTRLPGDADVMIPERHSIAYFGKPSRDEIVDSLPLFVPEGCKPKFQDGWTALEYNQMKLMRTYNVETAAQG

SEQ ID NO: 429 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcccggaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 430 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERPEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 431 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgttgcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 432 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCCATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 433 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgttttatcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 434 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFYPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 435 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgtattaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 436 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLYYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 437 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgggaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 438 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFGKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 439 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtgtggcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 440 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCVATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 441 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggaatggttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 442 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGMVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 443 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgccgcgaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 444 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERREVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 445 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcataaggttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 446 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHKVVSPTRLPGDADVMIPERHSIAYFGKPSRDEIVDSLPLFVPEGCKPKFQDGWTALEYNQMKLMRTYNVETAAQG

SEQ ID NO: 447 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattcttgggtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 448 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSWVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 449 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcaggcgaatataaccaaatgaaattgatgcgtacatacaacgtcgagactgctgctcagggt

SEQ ID NO: 450 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTAGEYNQMKLMRTYNVETAAQG

SEQ ID NO: 451 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagcctagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 452 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKPSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 453 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgtctgtgccagaaggttgtaagcctaaattccaagatggttggacggcattagaatataaccaaatgaaattgatgcgtacatacaacgtcgagactgctgctcagggt

SEQ ID NO: 454 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLSVPEGCKPKFQDGWTALEYNQMKLMRTYNVETAAQG

SEQ ID NO: 455 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgccggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcacctgggagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 456 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLPDERVDEAFSWSNKFFNLPLEIKQKAKHPLAPNPHRGYSGVGQEKISAITGFEKGERSEVRTWEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 457 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttattcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 458 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESLFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 459 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactggcggtgccagaaggttgtaagcctaaattccaagatggttggacggcattagaatataaccaaatgaaattgatgcgtacatacaacgtcgagactgctgctcagggt

SEQ ID NO: 460 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLAVPEGCKPKFQDGWTALEYNQMKLMRTYNVETAAQG

SEQ ID NO: 461 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagacgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 462 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQTLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 463 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcacctgggagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 464 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTWEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 465 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcaatgaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 466 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERNEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 467 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgtggagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 468 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTVEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 469 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgccatgaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtctttcgcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 470 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERHEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 471 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacataccgtgtcgagactgctgctcagggt

SEQ ID NO: 472 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYRVETAAQG

SEQ ID NO: 473 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgatgagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 474 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTDEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 475 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacaggtgatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 476 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQVIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 477 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgacggtgccagaaggttgtaagcctaaattccaagatggttggacggcattagaatataaccaaatgaaattgatgcgtacatacaacgtcgagactgctgctcagggt

SEQ ID NO: 478 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLTVPEGCKPKFQDGWTALEYNQMKLMRTYNVETAAQG

SEQ ID NO: 479 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcacccctgagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggaggcggatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 480 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTPEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEADDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 481 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctgctgtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtagtgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 482 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSAVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVVIPERHSIAYFGKPSRDEIVDSLPLFVPEGCKPKFQDGWTALEYNQMKLMRTYNVETAAQG

SEQ ID NO: 483 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 484 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTAHEYNQMKLMRTYNVETAAQG

SEQ ID NO: 485 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 486 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 487 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactttgctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 488 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDQENPGVFVPVEPDDVHEMIINVGDCLSRWTDGRLRSVNHRVVSPTLLPGDADVMIPERHSIAYFGKPSRDEIVDSLPLFVPEGCKPKFQDGWTALEYNQMKLMRTYNVETAAQG

SEQ ID NO: 489 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagcaagggggacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatctgtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgtcagtccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagcgcgctgaacagggt

SEQ ID NO: 490 - protein, 349 aa, Artificial Sequence
  Engineered Variant of Proline Hydroxylase from Fungal sp. No. 11243
MGSHHHHHHHHSGSIPSLDYQLFSKGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHLSLLQCIATGLSLPSDELSSRCAKCSNELRLLHYPATPASSLASGECRISPHSDFGTITLLFQDSVGGLQAEDTENPGVFVPVEPDDVHEMIINVGDCLVRWTDGRLRSVNHRVVSPTRLPGDADVMIPERHSIAYFGKPSRDEIVDSLPLFVPEGCKPKFQDGWTALEYNQMKLMRTYNVERAEQG

SEQ ID NO: 491 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 492 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 493 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccatggggacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgtcagtccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 494 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSNELRLLHYPATPASSLASGECRISPHSDFGTITLLFQDSVGGLQAEDTENPGVFVPVEPDDVHEMIINVGDCLVRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 495 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagaggtacgtgaaacctgggaccaaggacctgcggacgatgagctgtattcgaatcgttggttccctgacgaagatttacctggcttccgctcttttatggagtcgttcttctcggaatgtcagactcttcatcagtcgttgttacagtgtatcgcgacgggcttaagtgtaccatctgacctgctttcctcacgttgtgccaagtgcagcaacgaattgcgtttgctgcactaccctgcgactccggggtcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtgaatcatcgcgttgtctctccaactcgcctgccgggagatgcggatgtaatgattccggaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 496 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEVRETWDQGPADDELYSNRWFPDEDLPGFRSFMESFFSECQTLHQSLLQCIATGLSVPSDLLSSRCAKCSNELRLLHYPATPGSSLASGECRISPHSDFGTITLLFQDSVGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 497 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttctcggaatgtcagactcttcatcagtcgttgttacagtgtatcgcgacgggcttaagtgtaccatctgacctgctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgcggggggtttacaggcagaagatcaggagaaccctggagtgtttgtgcctgtggagccagatgacgttcatgaaatgattatcaatgtcggggattgtcttagtcgttggacagacggccgtttacgttcagtgaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 498 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPADDELYSNRWFPDEDLPGFRSFMESFFSECQTLHQSLLQCIATGLSVPSDLLSSRCAKCSNELRLLHYPATPASSLASGECRISPHSDFGTITLLFQDSAGGLQAEDQENPGVFVPVEPDDVHEMIINVGDCLSRWTDGRLRSVNHRVVSPTRLPGDADVMIPERHSIAYFGKPSRDEIVDSLPLFVPEGCKPKFQDGWTALEYNQMKLMRTYNVETAAQG

SEQ ID NO: 499 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcccagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctgcggacgatgagctgtattcgaatcgttggttccctgacgaagatttacctggcttccgctcttttatggagtcgttcttcgtagaatgtcagactcttgtgcagtcgttgttacagtgtatcgcgacgggcttaagtctgccatctgacgagctttcctcacgttgtgccaagtgcagcaacgaattgcgtttgctgcactaccctgcgactccggcttcttcattggcgtcaggtgagtgtcgcattagtcctcactctgatttcggcacgattactctgttattccaagatagtgtagggggtttacaggcagaagatcaggagaaccctggagtgtttgtgcctgtggagccagatgacgttcatgaaatgattatcaatgtcggggattgtcttagtcgttggacagacggccgtttacgttcagtcaatcatcgcgttgtctctccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 500 - protein, 349 aa, Artificial Sequence; identical to SEQ ID NO: 416
  Engineered Variant of Proline Hydroxylase from Fungal sp. No. 11243

SEQ ID NO: 501 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 502 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 503 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtacgtctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 504 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERTSIAYFGKPSRDEIVDSLPLFVPEGCKPKFQDGWTALEYNQMKLMRTYNVETAAQG

SEQ ID NO: 505 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtctttgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 506 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGLCRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 507 - DNA, 1047 bp, Artificial Sequence
  Engineered Variant of Proline Hydroxylase from Fungal sp. No. 11243
atggggtctcatcaccaccaccatcatcatcacagcggttcaattccatgtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 508 - protein, 349 aa, Artificial Sequence
  Engineered Variant of Proline Hydroxylase from Fungal sp. No. 11243
MGSHHHHHHHHSGSIPCLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 509 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtatacgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 510 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYTNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 511 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggttcttgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 512 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGSCRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 513 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttagggtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 514 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLGCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 515 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagagaccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 516 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEETENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 517 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtctcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 518 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 519 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccagcggacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 520 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPADELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 521 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacccggcttccgctcttttatggagtcgttcttcgtagaatgtcagactcttcatcagtcgttgttacagtgtatcgcgacgggcttaagtctgccacctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 522 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPPDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 523 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccactggacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 524 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPLDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 525 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaactggtagatagccttccactgttcgtgccagaaggttgtaagcctaaattccaagatggttggacggcattagaatataaccaaatgaaattgatgcgtacatacaacgtcgagactgctgctcagggt

SEQ ID NO: 526 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDELVDSLPLFVPEGCKPKFQDGWTALEYNQMKLMRTYNVETAAQG

SEQ ID NO: 527 - DNA, 1047 bp, Artificial Sequence
  Engineered Variant of Proline Hydroxylase from Fungal sp. No. 11243
atggggtctcatcaccaccaccatcatcatcacagcggttcagttccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 528 - protein, 349 aa, Artificial Sequence
  Engineered Variant of Proline Hydroxylase from Fungal sp. No. 11243
MGSHHHHHHHHSGSVPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 529 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttcgtgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 530 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFVWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 531 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacattgcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 532 - protein, 349 aa, Artificial Sequence
  Engineered Variant of Proline Hydroxylase from Fungal sp. No. 11243
MGSHHHHHHHHSGSIPSLDYQLFSHGDIAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 533 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggaggtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 534 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDAEVMIPERHSIAYFGKPSRDEIVDSLPLFVPEGCKPKFQDGWTALEYNQMKLMRTYNVETAAQG

SEQ ID NO: 535 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtatggtaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 536 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYGNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 537 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtataataatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 538 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYNNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 539 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgtgtccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 540 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPACPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 541 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtatgtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgctcagggt

SEQ ID NO: 542 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGMCRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAAQG

SEQ ID NO: 543 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaactcggagactgctgctcagggt

SEQ ID NO: 544 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNSETAAQG

SEQ ID NO: 545 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacaccgagactgctgctcagggt

SEQ ID NO: 546 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNTETAAQG

SEQ ID NO: 547 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaaacatcctccggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagccgagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgtagtgtcaatcatcgcgttgcgaatccaactctgctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaacgtcgagactgctgagcagggt

SEQ ID NO: 548 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKPSSELRLLHYPATPASSLASGECRISPHSDFGTITLLFQDSVGGLQAEDTENPGVFVPVEPDDVHEMIINVGDCLVRWTDGRLRSVNHRVANPTLLPGDADVMIPERHSIAYFGKPSRDEIVDSLPLFVPEGCKPKFQDGWTALEYNQMKLMRTYNVETAEQG

SEQ ID NO: 549 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaaacatcctccggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagccgagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgtttgtgccagaaggttgtaagcctaaattccaagatggttggacggcattagaatataaccaaatgaaattgatgcgtacatacaatgtcgagactgctgagcagggt

SEQ ID NO: 550 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKPSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAEQG

SEQ ID NO: 551 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaaacatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgtagcagtgaattgcgtttgctgtactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcattagaatataaccaaatgaaattgatgcgtacatacaatgtcgagactgctgagcagggt

SEQ ID NO: 552 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLYYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTALEYNQMKLMRTYNVETAEQG

SEQ ID NO: 553 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaaacatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtctgccatctgacgagctttcctcacgttgtgccaagtgtagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgagtccaactcgcctgccgggagatgcggatgtaatgattccagaacgtcactctatcgcgtatttcggaaagccatctcgcgacgaaattgtagatagccttccactggcggtgccagaaggttgtaagcctaaattccaagatggttggacggcattagaatataaccaaatgaaattgatgcgtacatacaatgtcgagactgctgagcagggt

SEQ ID NO: 554 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSLPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVASPTRLPGDADVMIPERHSIAYFGKPSRDEIVDSLPLAVPEGCKPKFQDGWTALEYNQMKLMRTYNVETAEQG

SEQ ID NO: 555 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgtggaggtacgtgaaacctgggaccaaggacctatcgacgatgagctgtattcgaatcgttggttccctgacgaagatttacctggcttccgctcttttatggagtcgtttttcgtagaatgtcagactcttgttcagtcgttgttacagtgtatcgcgacgggcttaagtgtgccatctgacgaactttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgttgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 556 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTVEVRETWDQGPIDDELYSNRWFPDEDLPGFRSFMESFFVECQTLVQSLLQCIATGLSVPSDELSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 557 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgcagagccgcgtgaaacctgggaccaaggacctatcgacgatgagctgtattcgaatcgttggttccctgacgaagatttacctggcttccgctcttttatggagtcgttcttcgtagaatgtcagactcttcatcagtcgttgttacagtgtatcgcgacgggcttaagtgtgccatctgacgaactttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgctgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 558 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLHQSLLQCIATGLSVPSDELSSRCAKCSSELRLLHYPATPASSLASGECRISPHSDFGTITLLFQDSAGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 559 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgctcagaggtacgcaccgtggaggtacgtgaaacctgggaccaaggacctatcgacgatgagctgtattcgaatcgttggttccctgacgaagatttacctggcttccgctcttttatggagtcgtttttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagaacgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 560 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTVEVRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 561 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 562 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 563 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtggcgacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 564 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVATFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 565 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctaaacagggt

SEQ ID NO: 566 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAKQG

SEQ ID NO: 567 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacaccctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 568 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDTLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 569 - DNA, 1047 bp, Artificial Sequence
  Engineered Variant of Proline Hydroxylase from Fungal sp. No. 11243
atggggtctcatcaccaccaccatcatcatcacagcggttcatttccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 570 - protein, 349 aa, Artificial Sequence
  Engineered Variant of Proline Hydroxylase from Fungal sp. No. 11243
MGSHHHHHHHHSGSFPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 571 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttagtggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 572 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFSGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 573 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagcagttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 574 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQQLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 575 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgaggatgctgctcagggt

SEQ ID NO: 576 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVEDAAQG

SEQ ID NO: 577 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagctggttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 578 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDELVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 579 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaaggagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 580 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKEKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 581 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgcaattttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 582 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRNFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 583 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcggtgtatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 584 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAVYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 585 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccgcgcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 586 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAAHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 587 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgcggtatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 588 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFARYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGECRISPHSDFGTITLLFQDSVGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 589 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgtagcagtgaattgcgtttgctgcactaccctgcgactccggcttcttcattggcgtcaggtagctgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgagcccaactcgcctgccgggagatgcggatgtaatgattccagagcgtacctctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacgtggagactgctgaacagggt

SEQ ID NO: 590 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGSCRISPHSDFGTITLLFQDSTGGLQAEDTENPGVFVPVEPDDVHEMIINVGDCLVRWTDGRLRSVNHRVASPTRLPGDADVMIPERTSIAYFGKPSRDEIVDSLPLFVPEGCKPKFQDGWTAHEYNQMKLMRTYNVETAEQG

SEQ ID NO: 591 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtattgcgacgggcttaagtgtgccagcggacctgctttcctcacgttgtgccaagtgcagcagtgaattgcgtttgctgcactaccctgcgactccggcttcttcattggcgtcaggtagctgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtggagactgctgaacagggt

SEQ ID NO: 592 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPADLLSSRCAKCSSELRLLHYPATPASSLASGSCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAEQG

SEQ ID NO: 593 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtattgcgacgggcttaagtgtgccaccggacctgctttcctcacgttgtgccaagtgcagcagtgaattgcgtttgctgtactaccctgcgactccggcttcttcattggcgtcaggtgagtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacaccgagactgctgcacagggt

SEQ ID NO: 594 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPPDLLSSRCAKCSSELRLLYYPATPASSLASGECRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAAQG

SEQ ID NO: 595 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcgcagcgccaacagttctgtgaggaccttgtgaaaacatttgcgggatatggatttgttaaactgcgcaatcacgggctgccggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtattgcgacgggcttaagtgtgccatcggacctgctttcctcacgttgtgccaagtgtagcagtgaattgcgtttgctgtactaccctgcgactccggcttcttcattggcgtcaggtgagtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgagcccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtggagactgctgcacagggt

SEQ ID NO: 596 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLPDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLYYPATPASSLASGECRISPHSDFGTITLLFQDSVGGLQAEDTENPGVFVPVEPDDVHEMIINVGDCLVRWTDGRLRSVNHRVASPTRLPGDADVMIPERHSIAYFGKPSRDEIVDSLPLFVPEGCKPKFQDGWTAHEYNQMKLMRTYNVETAAQG

SEQ ID NO: 597 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 598 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 599 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcacagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtattgcgacgggcttaagtgtgccatcggacctgctttcctcacgttgtgccaagccaagcagtgaattgcgtttgctgcactaccctgcgactccggcttcttcattgtcgtcaggtctgtgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgagcccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 600 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKPSSELRLLHYPATPASSLSSGLCRISPHSDFGTITLLFQDSVGGLQAEDTENPGVFVPVEPDDVHEMIINVGDCLVRWTDGRLRSVNHRVASPTRLPGDADVMIPERHSIAYFGKPSRDEIVDSLPLFVPEGCKPKFQDGWTAHEYNQMKLMRTYNVETAAQG

SEQ ID NO: 601 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcaatgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtattgcgacgggcttaagtgtgccaccggacctgctttcctcacgttgtgccaagccaagcagtgaattgcgtttgctgtactaccctgcgactccggcttcttcattggcgtcaggtagctgtcgcattagtcctcactctgatttcggcacgattactctgttattccaagatagtgtagggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgagcccaactcgcctgccgggagatgcggatgtaatgattccagagcgttactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 602 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERNEVRTAEPRETWDQGPIDDELYSNRWFPDEDLPGFRSFMESFFVECQTLVQSLLQCIATGLSVPPDLLSSRCAKPSSELRLLYYPATPASSLASGSCRISPHSDFGTITLLFQDSVGGLQAEDTENPGVFVPVEPDDVHEMIINVGDCLVRWTDGRLRSVNHRVASPTRLPGDADVMIPERYSIAYFGKPSRDEIVDSLPLFVPEGCKPKFQDGWTAHEYNQMKLMRTYNTETAEQG

SEQ ID NO: 603 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccggcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctctggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtattgcgacgggcttaagtgtgccagcggacctgctttcctcacgttgtgccaagtgcagcagtgaattgcgtttgctgcactaccctgcgactccggcttcttcattgtcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaacccaactcgcctgccgggagatgcggatgtaatgattccagagcgtcactctatcgcgtatttcggaaagccatctcgcgacgaaattgtagatagccttccactgttcgtgccagaaggttgtaagcctaaattccaagatggttggacggcacatgaatataaccaaatgaaattgatgcgtacatacaacgtcgagactgctgctcagggt

SEQ ID NO: 604 - protein, 349 aa, Artificial Sequence
  Engineered Variant of Proline Hydroxylase from Fungal sp. No. 11243
MGSHHHHHHHHSGSIPSLDYQLFSHGDPAQRQQFCEDLVKTFAGYGFVKLRNHGLSDERVDEAFSWSNKFFNLPLEIKQKAKHPLAPNPHRGYSGVGQEKISAITGFEKGERSEVRTAEPRETWDQGPIDDELYSNRWFPDEDLPGFRSFMESFFVECQTLVQSLLQCIATGLSVPADLLSSRCAKCSSELRLLHYPATPASSLSSGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNVETAAQG

SEQ ID NO: 605 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactctttctcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 606 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLSQSLLQCIATGLSVPSDLLSSRCAKCSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 607 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcgtgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 608 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGLCRISPHSDFGVITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 609 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggacaggttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 610 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGQVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 611 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcacgattactctgttattccaagataggactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 612 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGLCRISPHSDFGTITLLFQDRTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 613 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgcatcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 614 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGLHRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 615 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacatgaccgagactgctgaacagggt

SEQ ID NO: 616 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYMTETAEQG

SEQ ID NO: 617 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacttgaccgagactgctgaacagggt

SEQ ID NO: 618 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYLTETAEQG

SEQ ID NO: 619 - DNA, 1047 bp, Artificial Sequence
  Engineered Variant of Proline Hydroxylase from Fungal sp. No. 11243
atggggtctcatcaccaccaccatcatcatcacagcggttcaatcccagtattagactatcaactgttcagccacggtgacccgtcgcagcgccaacagttctgtgaggaccttgtgaaaacatttgcgcgctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgcactaccctgcgtgtccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaacccaactcgcctgccgggagatgcggatgtaatgattccagagcgtcactctatcgcgtatttcggaaagccatctcgcgacgaaattgtagatagccttccatgttttgtgccagaaggttgtaagcctaaattccaagatggttggacggcacatgaatataaccaaatgaaattgatgcgtacatacaacaccgagaccgctgaacagggt

SEQ ID NO: 620 - protein, 349 aa, Artificial Sequence
  Engineered Variant of Proline Hydroxylase from Fungal sp. No. 11243
MGSHHHHHHHHSGSIPVLDYQLFSHGDPSQRQQFCEDLVKTFARYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLHYPACPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPCFVPEGCKPKFQDGWTAHEYNQMKLMRTYNTETAEQG

SEQ ID NO: 621 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgcgctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgtacatgaaatgattatcaatgtcggggattgtcttgtgcgttggacagacggccgtttacgttcagtcaatcatcgcgttgcgaacccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagaccgctgaacagggt

SEQ ID NO: 622 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFARYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDTLSSRCAKCSSELRLLYYPACPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 623 - DNA, 1047 bp, Artificial Sequence
  Engineered Variant of Proline Hydroxylase from Fungal sp. No. 11243
atggggtctcatcaccaccaccatcatcatcacagcggttcaatcccagtattagactatcaactgttcagccacggtgacccgtcgcagcgccaacagttctgtgaggaccttgtgaaaacatttgcggtctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacacgctttcctcacgttgtgccaagtgcagcagtgaattgcgtttgctgtactaccctgcgactccggcttcttcattggcgtcaggtctgtgtcgcattagtcctcactctgatttcggcacgattactctgttattccaagatagtactgggggtttacaggcagaagataccgagaaccctggagtgtttgtccctgtggagccagatgacccgcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccatgttttgtgccagaaggttgtaagcctaaattccaagatggttggacggcacatgaatataaccaaatgaaattgatgcgtacatacaacaccgaggacgctgaacagggt

SEQ ID NO: 624 - protein, 349 aa, Artificial Sequence
  Engineered Variant of Proline Hydroxylase from Fungal sp. No. 11243
MGSHHHHHHHHSGSIPVLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDTLSSRCAKCSSELRLLYYPATPASSLASGLCRISPHSDFGTITLLFQDSTGGLQAEDTENPGVFVPVEPDDPHEMIINVGDCLVRWTDGRLRSVNHRVANPTRLPGDADVMIPERHSIAYFGKPSRDEIVDSLPCFVPEGCKPKFQDGWTAHEYNQMKLMRTYNTEDAEQG

SEQ ID NO: 625 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgcgctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcacgattactctgttattccaagatagtactgggggtttacaggcagaagataccgagaaccctggagtgtttgtccctgtggagccagatgacgtacatgaaatgattatcaatgtcggggattgtcttgtgcgttggacagacggccgtttacgttcagtcaatcatcgcgttgcgaacccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgaggacgctgaacagggt

SEQ ID NO: 626 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFARYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDTLSSRCAKCSSELRLLYYPACPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTEDAEQG

SEQ ID NO: 627 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacattttcggtctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagtgcagcagtgaattgcgtttgctgtactaccctgcgtgtccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgtacatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagaccgctgaacagggt

SEQ ID NO: 628 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFSVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKCSSELRLLYYPACPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 629 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgaggacgctgaacagggt

SEQ ID NO: 630 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDTLSSRCAKCSSELRLLYYPACPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTEDAEQG

SEQ ID NO: 631 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtatatggatttgttaaactgcgcaatcacgggctgtcggatgagcgtgttgacgaggctttctcgtggagtaataaatttttcaatctgccacttgaaattaagcaaaaggccaaacatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgcaactttatggagtcgttcttcgtagaatgtcagactcttgttcagcagttgttacagtgtatcgcgatgggcttaagtgtgccatctgacctgctttcctcacgttgtgccaagccgagcagtgaattgcgtttgctgcactaccctgcgactccggcatctagtttggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 632 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRNFMESFFVECQTLVQQLLQCIAMGLSVPSDLLSSRCAKPSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 633 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcaaaaggccaaacatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgcaactttatggagtcgttcttcgtagaatgtcagactcttgttcagcagttgttacagtgtatcgcgatgggcttaagtgtgccatctgacctgctttcctcacgttgtgccaagtgcagcagtgaattgcgtttgctgcactaccctgcgactccggcatctagtttggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcagatacgatgattccagagcgtcactctatcgcgtatttcggaaagccatctcgcgacgaaattgtagatagccttccactgtttgtgccagaaggttgtaaacctaaattccaagatggttggacggcacatgaatataaccaaatgaaattgatgcgtacatacaacaccgagactgctgaacagggt

SEQ ID NO: 634 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRNFMESFFVECQTLVQQLLQCIAMGLSVPSDLLSSRCAKCSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADTMIPERHSIAYFGKPSRDEIVDSLPLFVPEGCKPKFQDGWTAHEYNQMKLMRTYNTETAEQG

SEQ ID NO: 635 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagtcgttgttacagtgtatcgcgacgggcttaagtgtgccatctgacctgctttcctcacgttgtgccaagccgagcagtgaattgcgtttgctgcactaccctgcgactccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatccagatgtgatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgagactgctgaacagggt

SEQ ID NO: 636 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQSLLQCIATGLSVPSDLLSSRCAKPSSELRLLHYPATPASSLASGLCRISPHSDFGTITLLFQDSTGGLQAEDTENPGVFVPVEPDDVHEMIINVGDCLVRWTDGRLRSVNHRVANPTRLPGDPDVMIPERHSIAYFGKPSRDEIVDSLPLFVPEGCKPKFQDGWTAHEYNQMKLMRTYNTETAEQG

SEQ ID NO: 637 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcaaaaggccgcgcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgcagctttatggagtcgttcttcgtagaatgtcagactcttgttgatcagttgttacagtgtatcgcgacgggcttaagtgtgccatctgacctgctttcctcacgttgtgccaagtgcagcagtgaattgcgtttgctgcactaccctgcgactccggcttcttcattggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcagatgtgatgattccagagcgtcactctatcgcgtatttcggaaagccatctcgcgacgaaattgtagatagccttccactgtttgtgccagaaggttgtaaacctaaattccaagatggttggacggcacatgaatataaccaaatgaaattgatgcgtacatacaacaccgagactgctgaacagggt

SEQ ID NO: 638 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAAHPPAPNPHRGYSGVGQEKISAITGFEKGERSEVRTAEPRETWDQGPIDDELYSNRWFPDEDLPGFRSFMESFFVECQTLVDQLLQCIATGLSVPSDLLSSRCAKCSSELRLLHYPATPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTETAEQG

SEQ ID NO: 639 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaagcagaaggccgcgcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgcagctttatggagtcgttcttcgtagaatgtcagactcttgttgatcagttgttacagtgtatcgcgatgggcttaagtgtgccatctgacctgctttcctcacgttgtgccaagccgagcagtgaattgcgtttgctgcactaccctgcgactccggtatctcaattggcgtcaggtatttgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatccagatacgatgattccagagcgtcactctatcgcgtatttcggaaagccatctcgcgacgaaattgtagatagccttccactgtttgtgccagaaggttgtgtacctaaattccaagatggttggacggcacatgaatataaccaaatgaaattgatgcgtacatacaacaccgagactgctgaacagggt

SEQ ID NO: 640 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKQKAAHPPAPNPHRGYSGVGQEKISAITGFEKGERSEVRTAEPRETWDQGPIDDELYSNRWFPDEDLPGFRSFMESFFVECQTLVDQLLQCIAMGLSVPSDLLSSRCAKPSSELRLLHYPATPVSQLASGICRISPHSDFGTITLLFQDSTGGLQAEDTENPGVFVPVEPDDVHEMIINVGDCLVRWTDGRLRSVNHRVANPTRLPGDPDTMIPERHSIAYFGKPSRDEIVDSLPLFVPEGCVPKFQDGWTAHEYNQMKLMRTYNTETAEQG

SEQ ID NO: 641 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcgggatatggatttgttaaactgcgcaatcacgggctgtcggatgagcgtgttgacgaggctttctcgtggagtaataaatttttcaatctgccacttgaaattaaggaaaaggccaaacatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttgatcagttgttacagtgtatcgcgatgggcttaagtgtgccatctgacctgctttcctcacgttgtgccaagaacagcagtgaattgcgtttgctgcactaccctgcgactccggtatctagtttggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatccagatacgatgattccagagcgtcactctatcgcgtatttcggaaagccatctcgcgacgaaattgtagatagccttccactgtttgtgccagaaggttgtaaacctaaattccaagatggttggacggcacatgaatataaccaaatgaaattgatgcgtacatacaacaccgagactgctgaacagggt

SEQ ID NO: 642 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAGYGFVKLRNHGLSDERVDEAFSWSNKFFNLPLEIKEKAKHPPAPNPHRGYSGVGQEKISAITGFEKGERSEVRTAEPRETWDQGPIDDELYSNRWFPDEDLPGFRSFMESFFVECQTLVDQLLQCIAMGLSVPSDLLSSRCAKNSSELRLLHYPATPVSSLASGLCRISPHSDFGTITLLFQDSTGGLQAEDTENPGVFVPVEPDDVHEMIINVGDCLVRWTDGRLRSVNHRVANPTRLPGDPDTMIPERHSIAYFGKPSRDEIVDSLPLFVPEGCKPKFQDGWTAHEYNQMKLMRTYNTETAEQG

SEQ ID NO: 643 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggattcgttaaactgcgcaatcacgggctgtcggatgagcgtgttgacgaagctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttagccagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcgtaatcactctgttattccaagatagtactgggggtttacaggcagaagatacggagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagacgcggatgtaatgattccagagcgtcactctatcgcgtatttcggaaagccatctcgcgacgaaattgtagatagccttccatgctttgtgccagaaggttgtaagcctaaattccaagatggttggacggcacatgaatataaccaaatgaaattgattcgtacatacaataccgaggacgctgaacagggt

SEQ ID NO: 644 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLSQSLLQCIATGLSVPSDTLSSRCAKCSSELRLLYYPACPASSLASGLCRISPHSDFGVITLLFQDSTGGLQAEDTENPGVFVPVEPDDVHEMIINVGDCLVRWTDGRLRSVNHRVANPTRLPGDADVMIPERHSIAYFGKPSRDEIVDSLPCFVPEGCKPKFQDGWTAHEYNQMKLIRTYNTEDAEQG

SEQ ID NO: 645 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggattcgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttagccagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcacgattactctgttattccaagatagtactgggggtttacaggcagaagatctggagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacatgaccgaggacgctgaacagggt

SEQ ID NO: 646 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLSQSLLQCIATGLSVPSDTLSSRCAKCSSELRLLYYPACPASSLASGLCRISPHSDFGTITLLFQDSTGGLQAEDLENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYMTEDAEQG

SEQ ID NO: 647 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttagccagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcacaattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccatgctttgtgccagaaggttgtaagcctaaattccaagatggttggacggcacatgaatataaccaaatgaaattgatgcgtacatacatgaccgaggacgctgaacagggt

SEQ ID NO: 648 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLSQSLLQCIATGLSVPSDTLSSRCAKCSSELRLLYYPACPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPCFVPEGCKPKFQDGWTAHEYNQMKLMRTYMTEDAEQG

SEQ ID NO: 649 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggattcgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttagccagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcacgatcactctgttattccaagatagtactgggggtttacaggcagaagatacggagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaataccgaggacgctgaacagggt

SEQ ID NO: 650 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLSQSLLQCIATGLSVPSDTLSSRCAKCSSELRLLYYPACPASSLASGLCRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTEDAEQG

SEQ ID NO: 651 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggatttgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttagccagtcgttgttacagtgtatcgcgacgggcttaagtgtgccatctgacacgctttcctcacgttgtgccaagtgcagcagtgaattgcgtttgctgtactaccctgcgtgtccggcttcttcattggcgtcaggtctgtgtcgcattagtcctcactctgatttcggcgtaatcactctgttattccaagatagtactgggggtttacaggcagaagatctggagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcctgccgggagacgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgaggacgctgaacagggt

SEQ ID NO: 652 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLSQSLLQCIATGLSVPSDTLSSRCAKCSSELRLLYYPACPASSLASGLCRISPHSDFGVITLLFQDSTGGLQAEDLENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTEDAEQG

SEQ ID NO: 653 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggattcgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtatccgaatcgttggttccctgacgaagatttacctggcttccgctcttttatggagtcgttcttcgtagaatgtcagactcttgttgatcaattgttacagtgtatcgcgacgggcttaagtgtgccatctgacacgctttcctcacgttgtgccaagtgcagcagtgaattgcgtttgctgtactaccctgcgtgtccggtatctcagttggcgtcaggtatttgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaacccaactcgcctgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgaggacgctgaacagggt

SEQ ID NO: 654 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYPNRWFPDEDLPGFRSFMESFFVECQTLVDQLLQCIATGLSVPSDTLSSRCAKCSSELRLLYYPACPVSQLASGICRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTEDAEQG

SEQ ID NO: 655 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggattcgttaaactgcgcaatcacgggctgtcggatgagcgtgttgacgaggctttctcgtggagtaataaatttttcaatctgccacttgaaattaagcagaaggccgctcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagactttgttacagtgtatcgcgatgggcttaagtgtgccatctgacacgctttcctcacgttgtgccaagtgcagcagtgaattgcgtttgctgtactaccctgcgtgtccggcatctcagttggcgtcaggtatttgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaacccaactcgcctgccgggagatgcggatgtgatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgaggacgctgaacagggt

SEQ ID NO: 656 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAAHPPAPNPHRGYSGVGQEKISAITGFEKGERSEVRTAEPRETWDQGPIDDELYSNRWFPDEDLPGFRSFMESFFVECQTLVQTLLQCIAMGLSVPSDTLSSRCAKCSSELRLLYYPACPASQLASGICRISPHSDFGTITLLFQDSTGGLQAEDTENPGVFVPVEPDDVHEMIINVGDCLVRWTDGRLRSVNHRVANPTRLPGDADVMIPERHSIAYFGKPSRDEIVDSLPLFVPEGCKPKFQDGWTAHEYNQMKLMRTYNTEDAEQG

SEQ ID NO: 657 - DNA, 1047 bp, Artificial Sequence
  Engineered Variant of Proline Hydroxylase from Fungal sp. No. 11243
atggggtctcatcaccaccaccatcatcatcacagcggttcaattccaagtttagactatcaactgttcagccacggtgacccgtcgcagcgccaacagttctgtgaggaccttgtgaaaacatttgcggtctatggattcgttaaactgcgcaatcacgggctgtcggatgagcgtgttgacgaggctttctcgtggagtaataaatttttcaatctgccacttgaaattaagcagaaggccaagcatcctccggcaccgaacccacaccgcggctattctggagtgggtcaggagaagatctcagctattaccggtttcgagaaaggcgaacgcagtgaggtacgcaccgcggagcctcgtgaaacctgggaccaaggacctatcgacgatgagctgtattcgaatcgttggttccctgacgaagatttacctggcttccgctcttttatggagtcgttcttcgtagaatgtcagactcttgttcagcaattgttacagtgtatcgcgatgggcttaagtgtgccatctgacacgctttcctcacgttgtgccaagtgcagcagtgaattgcgtttgctgtactaccctgcgtgtccggtatctcagttggcgtcaggtctgtgtcgcattagtcctcactctgatttcggcacgattactctgttattccaagatagtactgggggtttacaggcagaagataccgagaaccctggagtgtttgtgcctgtggagccagatgacgttcatgaaatgattatcaatgtcggggattgtcttgtgcgttggacagacggccgtttacgttcagtcaatcatcgcgttgcgaatccaactcgcgtgccgggagatgcggatgtaatgattccagagcgtcactctatcgcgtatttcggaaagccatctcgcgacgaaattgtagatagccttccactgtttgtgccagaaggttgtaagcctaaattccaagatggttggacggcacatgaatataaccaaatgaaattgatgcgtacatacaacaccgaggacgctgaacagggt

SEQ ID NO: 658 - protein, 349 aa, Artificial Sequence
  Engineered Variant of Proline Hydroxylase from Fungal sp. No. 11243
MGSHHHHHHHHSGSIPSLDYQLFSHGDPSQRQQFCEDLVKTFAVYGFVKLRNHGLSDERVDEAFSWSNKFFNLPLEIKQKAKHPPAPNPHRGYSGVGQEKISAITGFEKGERSEVRTAEPRETWDQGPIDDELYSNRWFPDEDLPGFRSFMESFFVECQTLVQQLLQCIAMGLSVPSDTLSSRCAKCSSELRLLYYPACPVSQLASGLCRISPHSDFGTITLLFQDSTGGLQAEDTENPGVFVPVEPDDVHEMIINVGDCLVRWTDGRLRSVNHRVANPTRVPGDADVMIPERHSIAYFGKPSRDEIVDSLPLFVPEGCKPKFQDGWTAHEYNQMKLMRTYNTEDAEQG

What is claimed is:

1. An engineered polypeptide having proline hydroxylase activity, comprising an amino acid sequence having at least 80% sequence identity to the amino acid sequence of SEQ ID NO: 4, and further comprising one or more amino acid substitutions as compared to SEQ ID NO: 4 at positions selected from the group consisting of: 194, 123, 21, 28, 58/247, 65, 80, 85, 95, 98, 117, 120, 159, 185, 199, 200, 233, 237, 243, 250, 268, 281, 282, 287, 289, 307, 324, 326, 327, 330, 338, 343, 346, and 348.

2. The engineered polypeptide of claim 1, comprising an amino acid sequence having at least 80% sequence identity to the amino acid sequence of SEQ ID NO: 4, and further comprising a combination of amino acid substitutions as compared to SEQ ID NO: 4 at positions selected from the group consisting of: 48/66/189, 48/66, and 66/82/85/135/189/267.

3. The engineered polypeptide of claim 2, comprising an amino acid sequence having at least 85% sequence identity to the amino acid sequence of SEQ ID NO: 4, and further comprising one or more amino acid substitutions as compared to SEQ ID NO: 4 at positions selected from the group consisting of: 21, 29, 44, 76, 85, 117, 120, 123, 129, 135, 139, 147, 162, 175, 179, 189, 195, 199, 208, 219, 228, 233, 236, 237, 243, 262, 277, 278, 281, 282, 289, 296, 307, 324, 326, 330, 335, 343, 345, and 347.

4. The engineered polypeptide of claim 1, wherein said polypeptide has at least 80% sequence identity to at least one amino acid sequence selected from the group consisting of SEQ ID NOs: 6, 8, 116, 118, 120, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656 and 658.

5. A polynucleotide comprising a nucleotide sequence encoding the engineered polypeptide of claim 1.

6. A polynucleotide comprising a nucleotide sequence encoding the engineered polypeptide of claim 4.

7. The engineered polypeptide of claim 1, comprising an amino acid sequence having at least 87% sequence identity to the amino acid sequence of SEQ ID NO: 4, comprising a substitution as compared to SEQ ID NO: 4 at position 194, and wherein the substitution at position 194 is 194L.

* * * * *